United States Patent 12,642,819 (COMPOSITIONS AND METHODS FOR TREATING INFLAMMATORY BOWEL DISEASE) - sequence listing, part 65

SEQ ID NO: 31 - DNA, 2799102 bp, Clostridium sp. (residues 1,399,552-2,799,102 of 2,799,102)
tgataatacaattataaatcaacctaaaattattacggatggttattataaagattttggcaatttgtttactgattagctatattgtattttatattggagaaatcatatatatttagatactatataaaatagtttacatatatcaaacaaatgttggaaagaaatgttaataaatatcttataattatcacaggtattaataaaaaccaagtggttttctcaatcgtattgtaaaaatacaaaaattaatttatttttatatggagtgtaaaaaggtaaaaggagagtaatatgtcagttgagagaataggcgtttcatcggtagaaaaaattataaatcaaatgggaatgatttttagagagcagcctgtggatgattatggaattgatgcgcaaattgaaattgttgaaaataaatgtgctaccggaaaattaattgctgttcagattaaatcgggtaacagttattttaaggaattaacaccaaatagtataatatatagaggaaaacgaaaacattatgattattggttgaatcattctttaccggtgataatcgttttgtatgatccagaaaaagataaatgttattggaatatagttaacaaagaaacagcaattttatctgaacaaaattggaagattgaaatttctttttctaatcttttagaaaactctaaatcatctttgattaaaattgcagacagattaacagagtatgaaaaaaagttcaatacttttttatttgcaaagccatggatgaaacaaattatttatggaaatagaattgttttaaatgttgaagaatggataaataaatcatccggtagaggtacttttaagctgaaaataattgataaaaatggtaatgataggcaggttgttaatagtacatttattgggtttggaacaaagccgtataatcaaatttttcaagaattatttccatgggcatttattactatagattacaattattataaagattatgatagcatagcaatgcgtgataatgattatgaagcagctgaatatacttattttgattctgttggtgcggtatttgatatgagtgaatttaaatatattgttcccaaagacgcactaccaataaaaaaatggatgtgtgatccttgtaatataagaccgtacagcataggtggaggggaagtagcgttctatcaattaatattagaattaaatgatgttgcaaaagcatttttaattttagatgatttcattaatgagacaaatttttatacattattaagttagataaaaaatattatagtgaagaattttttgaaattataataaatatttaacatgattaataatgtaacatattcttaaaaagtatgagataaataaaataacattgataaagtattaagtgattaaccgaagaataaacaattgtttataaattttttttgatttaaaaaattactaaatctaaataagtaggaattgtaaaatgtataaatgaagtatttatattgtgaaaaattggatgatataaatattttttaattaaatgagaagaggagattaaagcaaatggagacacatattcataatccgtataaagtaaattggaaaatgtacgggcttataggtgtgatatcaattttagtaatgatttttgcttctttttgttgccctaatgcacaaaatgtacaaagtattatttttgatataattagaaatttatcttacggaggtgttgcatctgtttttattgctttattaattgaaataggaaatgtcaaagagaaaaataataaagctaataatttgtatgaaatgatttatagtgatttaaaaattaatattttgtggtatttgaatggttgggcacaattttgtaatatagtatacaaagataaagaatacaaagatgaaaaacatacttggactgaatggtatggcattgttaaaaatcgttttatagaattagatgacaaaagacaagaacaagcactagaattctttaaagatgaattaatatataatttagatgtaatagaaaaatctatagattatataaataaacaacaatttattttgagtattaatgaattatacgatgaaaatttaaaatcaattattgagaattttaaatttgaatgttatggtgcaaagtcatttttaaaaataaattttaatagtgaaaaattttggaaatcatttgatgcaataaatgaggatttaaaaaaatatatatgtagttggacggatatacaatattataattattataaatttaaaccttttgatattttaactaataaaagtgatattagaaccgcaattatcgagagtaaaaaacataataaattaaagtaattttattacacgaattgttttagaaaggaagattaattaatgaactcaattttaattaaaccacatcattttattgatattattaaattatatggatttgggatagacagatttgttcctgatgaaaaaatgggacatgatttttataaggttgctaatgaaattattgataatccatctgttgatttaaaattaacaattgatggagatgatatttgtaaaccttgtaaaaaatatcatgaacaatgtatagatccattaacacatatacaaggatatacaagtaaagatgtttataataaaactttagataaaagaattataaaattatataacttaaatgatgaatattatacggcaaaacaattatgctctataattcaaaataataaagaatatatctttgaagtctgggatgaagaagataatgaggtaacacaaaaaagatatgaattatttttgcaaggggctcataaatttttagataacatttaaagaagaggtgatagaattgtcaaaaaaggaaaacgcgtattttcatttaccaggattatttgaattttatgaattatataaagtctttttaccattattctatcatcatcgtgaatatttttatgattggtgtgaaataggttctatttatggaagtcctgaagattgcttatggggtggaggacgtcttggtgaaggaaatcaaaatccttatgaagttctttcacttatggatcaatatcatatttcttcgcgacttactttcagtaattcattacttcaagaaaaacatcttcaagataaaagatgtaatgatctttgcactttatttgaaaaaagtgagattcaaagtgggattatcattcattctgatttgttactagaatatttaaaaaagaaatttccacgtttttattttgtttcttcaacaacgaaagttcttacaaaatttgaacaattagtagatgaattaaagagagatgactttttatatgttgttcctgattttcgtttaaataaagttcaacaattagaaaatcttttacaaaaagataaggataaaattgaatttttatgtaatgaatgctgttttataggatgtcttgaacgaaagaaatgttatgaaacggttagccgtcaaaatctaggagaagattgtttagatcatgtatgcaaggcaccagattctcatgaggggtatcgtttttctaaagctatgcaaaattcgagttttatcagtgttgaagatattcaaaataattatctaccaaaaggcttttctcaatttaaaatagaaggtagaagtttagggagtgctttagtgttagaatttttactttattatatggtaaaacctgaatatcaaatacatgtaagagaagctatttatttagataatatgttagatttgttttaaaaaataagaaggataaaacatgtaaagtgtataaattattaaagaaataaaaaggagaacatatatgaaaatagaatataaagaaggtcttattgttttaaaagatcaggatgaagaagtcggttatattaaatatgttagaaaagaagaaaatgtgattgatgttatttcaacagttgttcatgaaaaatatcaaggtcaagggatggcaggaaagctttttgatgctttgatgggctatgtaaaagacaattctttgaaaataattccatcttgtagttatattgaaaagaagttgataaaactaccaaattctagtgattttttgcataaatagggcaaaaaaggatattatacgcaaaaaattaatatttatgcttaaaaataacaatattttcttgcaattaggaaagattctctatataatacttttgtaaattaagagtcaaaggggggaatcatcatggcaaaaactgtagtaagagaaaacgaatctttagatgacgctttacgtcgttttaaaagacaagtatctagaacaggtacccttgctgaagctcgtaaaagagaattctatgttaaaccaggattaaaaagaaaattaaaatctgaagcagcaagaaaaaataataaaaaaagataataaaaatacagccttcttggctgtttttttatgccgttttttcattgaaaaaataagtatcatttagtatactttatatgataaaaataaagatgtttttaatcgaaaaagggagaaactatgaaaactgtattaaaaaatggaaatgttttttaccaaaataaaattcaaaaattagatgtagaaattgatggtgaaacaattagtcaaataggtcatgatttagatggtgaaaatataattgattgtacagatcttttagtaacaccaggttttgttgatcttcatgttcatttacgtgaaccaggatttgaacataaaggaactattaaaacagaaactttatctgctaaatatggaggatatacgcatattgtagcgatggctaatacaaatccatgtatggatgataaagaaactattgaagattttattcaaagagttcaaaaagatagctctattcacacatatacttatagtgctattacgaaagatttaaaaggacaagagcttgttgattttaaagaaaataatgcttttgatattgtacagggattttctgatgatggaaaaggtgttcaaagtaaagaaatgatggcaaaagccatgaaagaagcaaaagcaatcaatagtattattgttgctcattgtgaagatgaaggagaacttgaaaaaggagcatgtattaacttaggacgtgtttctaaagaaaatggtcttgtaggaatcaataatgcttcagaatataatcatgctttacgtgatttacaattatctaaagaaattggtaatcgttatcatatttgtcatatttctactaaagaaactgtggcaggattaagagaatatcgaaaacaaggacttcctgtttcaggagaagcttgtccacatcatttgattttaacagatgaaaatattaaaaacttaaatccaaattataaaatgaatccaccacttcgaagtaaagaagatttagatgctttaattgaaggacttaaagatggaacagtgacatgtatctcaacagatcatgcacctcatagtgatgaagaaaaattaaaaccaattgatcaagcaccatttggtattattggtaaccaacatgcttttagtcttgtttatacatatttagttaagaagaatttgttagatttagaaactgttttaaaatgtatgacagtcaatccaagtcaagtaattggattggatcatgatattgctgttggtaaaaaagctaatattgctatcattgatttaaatgaagaatatacgattacgagagataatatttattcaaaagcaaagaatacaccatttttagatacaaaatgttttggattagtgaagtatcatattttagatggaaaaatagaaaaattataggaggaatttatgaactatcaagggttaatggaaattacaaaaattgaaaacattgcagatgatgtttatgaaatgactttaaaaggagaaggggctaaatatattagccaaccaggtcaattcattaatattaagatcaatgaaagtttacaaccttatcttagaagaccaatgtctatttcagattacgatgaaaatacaattgtgattgtttttaaagttgttggtcaaggaacagaaattttaaagaataaacaaattggagatcaattggattgtttaattggtttaggaaatggttttactgttcaagaaggaaaagctttacttattggtggaggacttggaacaccacctctttataacttaggtaaaaaattaaaagaaaaaggtgtagaagtgacaactgttttaggattttcttctaaaaaagatgttttctatattgataaattccaagaatttggagatgtattaattgcgacaatggatggttctttaggtgttaaaggaacagttattgatgttattaaaaaagctaatttaacatttgatcattattatacatgtggacctgaaccaatgttagatgcgcttgctttaaattatccagaaaacggacaactttcttttgaagcaagaatgggatgtggttttggagcttgtatgggatgttcatgtaaagtgaaaacaaaaccttataaacgtatttgtgtagaaggaccaattttattaagtgaggaggttattgtaaatggttaatttaaaagttaaacttccaggtttggaaatgaaaaatccagtgattccagcatcaggaacttttggatttggatatgaatttacaagattctatgatattaatgttttaggaagtatcatgattaaaggaacaacgcttgaaccacgttatggaaatcctttaccacgtattgcggaagggccaagtggaatgcttaatgcaattggactccaaaatcccggtgttgatgccgtcatgtctcatgagctagaagaacttcgtaaatgttataatgataaagtcatcgctaatattggtggaagctgtattgatgactatgttgaaactgcaaaacgtatttcaacacatgatatggtaggagcgttagaacttaatatttcttgtccaaatgttcatagtggaggtattcaatttggaacaaatccacaaatggctgcggatgttacacgtaaagtaaaagccgtttctcaaaaaccggtttatgttaaactttctcctaatgtaacagatatcgttgaaatggcaaaggctgtagaagaagctggagctgatggaattacaatgatcaatactttagtaggtatgcgttttaatatcaaaactggaaaaccgattatcgctaatggaacaggtggttattcaggaccagctattttcccagtagctttacgtatggttcatcaagtaagtaaagctgttaagattccagtaattggtatgggtggtatttcaagtgcccatgatgttattgaaatgatggttgcaggcgcaagcgctgtggcgattggttgtcaaaaccttgttgatccatatgcttgttataaaattattcaagatttaccaaaggaacttgaaaagcttggtgttgaagatattaatgatattgttggattatcacatcaataaaaagagaaatgaaagatttctctttttctatcattatccatgtaatataataagataaataggggtgaaataaatggatttagatacattgttaaataaaaatcaaaaagaagcagcaacgtatttagatagtcacttaagaattattgcgggggcaggttctggaaaaacaagagttgtgacttatcgtattgcacatttaatacaggatgtaggaattgatcctcgttctattttggcaattacttttaccaataaagctgctaacgagatgaaagaaagagtgaatgaagttgtaggtattcatggaagtggaacacttatttgtacgattcattctttatgtgtgagatttttaagacaacatattaatgttttaaattatccaagtaattttacaattatggatgaagaagatcaaaaagcacttattaaaaagctttatacacaattagaaatagatgcaaaagttatttctattaaaagtatgatcaatacaatttcttcatataaaacagcaagagtttctccacaaagagctattgaattagctggacaattttcaggagaactcaaaaaagcaaaagtctatgaagcctatgaaaactataaagaagatcatttcttattagattttgatgatttattattaaaagcagtttatattttggataattatccagatatattagaaaaatggcaaagaaaattccaatatattcatgtagatgaattccaagatgtaggtgaaattgaatatcatttagttcaattattatcaaaatatgccattgtttgtgtcgttggagatcctgatcaaacaatttatagctttagaggagcagatgttcattttattttagattttgataaagatttcaaacctaataaaacaattattcttgatcaaaactatcgttcaactggaaatatattaaaagtatcaaataatttaattcgtaaaaatagtcaacgtttagaaaagaatctttttacaaagcaaacaggtggagaagatgtgattcaccatgttgctaaaagtgaagaagaggaagctaattggattgctaataaaatcgaagatattgtaaataatcaagatggggttaattatcgtgatattgcaattttatatcgtgcaaactatttatcacgtacgattgagcaagtattgattcgtaaaggaattgattatcgtatttttggggggttaaaattctttaatcgtaaagaagttaaagatgctttaagctatttaagacttgtttgtaatcaagaagatttagcgtttgaaagaattattaatacaccagctagaggtattggtaaaaaaacattagaaaatattcaattagtagcacttaatcatcaaatttcactttatgatgctttaacgcttcatagtgatgaaattagactatctaataaatctaaaaaagaagtgcgaattttagttgaagcaattgaaaaagcaagacgttcaactttaccattacatgaaatgtttgaacaattaatgattgatgtaggctacatcgatatgttaaaaaatgatttagaagataatcgaattgataatattcatgaattacaacgttctatttatgattttcaagtttctcatgaggatgcaccaactttagaaaattatttacaagatatttctttatatacagataatgattctattgatcaagggcaatatgtttctttaatgtctattcatatggctaaaggtctagaatttgattatgtctttgttttaggcttatctgaaggaattttcccaagctttagaagtttagctgaagatggagatgatggtcttgaagaagaaagaagactcgcatatgtagcctttacaagagcgagaaaacagcttttcttaacagatagtgaaggatttagttttgtaacagattcacctaaaatttctagtcgtttcattgatgaagtaggaaatgaaggaattattcatagcggaagtaagcctcgttttaaaacaacagattatgtacctaaacaaacagtgtctaaagcagaattaattggagataataaagttgatgattggaaagtaggagaccttgtaaatcatgatatttttggtaagggtgttgttgttaaggtcaataagaatattttagatattgcttttgagcttccagcaggactgaagtctttaatggccaatcataaagcattaaaaaaacttacaaattagagaattcttagaattctctttttagtattattttgttataatgaaaaagatttgaaaaaggagtaagaatatggatgatttaaaaagatatgaagaattagtaaaaacaattgaatatcataatgatcgttattataaccaagacgatccagaaataagtgattatgaatatgatatgatgatgaaagaacttaaaaaactagaaaaggatcatcctgaatatgtcacaccaagttcgccaactcaacatgttgggggaagtgctaaaagagaagccggtgttttagttagacatcgtgtcccaatgctttctttacaagatgttttttctaaagaagaagttcaagaatttgtggaatcaatgcaagaaacgttggttgatccagtatttgtggttgaatataaaattgatggtttatcaatggctttaagatatgaaaatggtcttttaacaacggctattactcgtggagatggaatcattcaaggagaagatgtaaccgttaatgctaaagtaatcaaagatgttaaaaataaattaaaggaacctattgaatatcttgaagtacgtggtgaagtttatatgacaaatgaggcctttgataaagttaatgaaattcaagagcttaataataaaaaaactttcgcaaatcctagaaactgtgcggcaggaacattacgtcaattagatagtcgtattacaaaacaaagaaatctttctatgtttatttttaatattcaagatattcgaggaaaagaaattacgagtcatagtcaaggttatgaatatttaaaaattcaaggaatgaaagtcattgataattatcaaatttgtcatagctttgaagaagtatggaaagctattgagatgattggtgaaagtagagatcaattaggctatgatatagatggtgctgttgttaaaattaatagctatgcacaaagacaacaattagggcaaacagccaaagtgcctcgttgggccgtggcttataaatatccgccagaagaaaaagaaacaaagcttttagatatagaactttcagttggaagaacaggtagaattacaccaacagctatctttgaaccagtccgtttatgtggaacaacggtttcaagagcaacgcttcataatcaagattttattgatagtttagatgtacgtcttggcgatacaatcattgtttataaatcaggagaaatcattcctaaagtaaaaggtgtcaataaagataaaagacctgcaggaagtgttccttatcaaataggaaatacgtgtcctgtatgtggggcaccaacgtatcaagaagaggggacagttgatattaaatgttctaatcctacatgtccaagtaaactagttagaaatgttgttaattttgtaggaagagatgccatggatattaaaggttttggtttatcgtatgttgaaactttaatagatcaagggtatattcatgatgtcagtgatatttatattttaaaagataaaagacaagaacttttagataaaaaggtaattggtcttgttaaaagtacagataatttattaaatgccattgaaaaaagtaaagaaaatgatgcaacgaaggttttaactgctttaggtatttcaaatattggtaaatcggctgcaaaatctttaatgaagaaatttaaaacgatggatcaattgatgaatgcttcttatgaacaacttattgaagtcaatgatattggtgataccagtgcacaaattttaattgattattttaaagatgaaaagaataaagaaatcattcataaattagagcactatggattaaagatggaaattgaagatactcaaagttcatctatattagaaaatatgacttttgttgttacaggaacacttcctacattatctagaaaagaagcagctactttaatagaaaataatggtggtaaagtttctggatccgtttctaaaaagacaacctatttattagcaggggaaaatgcaggtagtaagcttacaaaagcacaatctttaaatattccagttttaacggaagaaatgtttatggaaatgataaaatcataattttatgctataatgtgccaaaaaaggagggtgctcatgaaaaaactatttacagttatattatgtttacttctttgtacaggatgtacgtcaaaaacaagtaaaaaagaaacaaaaagtagccaagatacatcatctactgattctttagatgattcattttatcctattgttaatttaggaacgaatcttgtaagagaaactttttatcaagatttttcttcctctgaagattttcaaacaataggaagagaattacaagctttatcgacagattatttctctacttcagattattatatgtctgagggtctacaacttgttcaaaatgataaaaatcaacttttaaagaaagaaaaatattctttacaaccattaaatggagaattagttgatggtcaagaaattaataagatggtagaaaatattagtgaacaagattattatgaaaaaagtggagataagtatactttaaaaggaatgtctatagcgattattctagatccaaaaggtggaacgaatacaactttatctgaaggaagtatagacagttacgcaaaagaaacgatttctagattatataagtacttacaaacaaaaaaatctgtgaaagatattcctacttttattgctgtttatcgtcaaaatgacagtgaagaaaatagttataatggacgctttatttatagtagttattgtcaaaatggaaaagttggaaatattaaatctttagattatgctacttatatttttacaagtgatgaagcaaataaagcagatgaagctctatattcacaattttcggtttttaaaaacaatgtaaaaaatgcttcaactgaagctgttggtgttgtaggttatgggaaatataaagatggttcaattcaaagtttaaaaattcaaattactgcgagtgtaaaaagttatacagaacttatttatgtagtagaaacagttgcagaccaaatggataatcatttttctggatttgatagttatgcagtgattaatgatcaagatggattgaaagctgttgtgattaaaaatgctggaaaggatgcacaaagtacattgttgtattaatgatagacatttgatacaatgatagaagagaaggtgaaagaatggcaagagaaagattttcttttgatgatacaatcgaatttgataaagatgaattaaaaccaaataatgatattcatgcaaatcatacagggaaatttacatttgatgatgaagtaaaggagaaaaaggtggctaaaccaaaaaagaaaaagagaaagcttaaaatatggcatgttgttttaactttatttgttgttacagtagttgcttttttcctttatatttttgttttttcaggaaataataatggacctgtttatggagaaagatgtgtgaaattattatctgttgataaaaatgcaattactcaagttgaatcacaaatagaacaagatgaaaatattcaagatgttgcaattaaagttagttgtcgtacaattaagcttacttatcaattatcagataatattcaagttgatactgctaaatctttagttgaaaattctttgcatacttttgatgatgcaatgggacaaagtaaagaagatggtgctgcatggtcacaacttttaaataaagcaaatggacgtttacaatatgatttagaaattattgtaaaatctaatggtgaaagtgatttcccattatttggaacaaaacatgcaggtgttgatgcaattacctatacaggtcaaaatgttaaagatcaagcatcagcagataaagcaattcaaagacaagcagaagtcgatgcagcaaataaagctgccgcaaataataatcaataaacgagctcagctcgtttttttggaggaaaaaatgaagaaaaatgattattttataggagaatgtgttgatcaatctcatgatggaaaaggaatcgttaaatatgaaggatttacttattttgtaaatggcatgattacaggggaagttggacaaattaaatgtattaaaatgttaaaaaattatggagtaggaagattaattgaattacaaaagccttcacctgaaagagtgaatcctaaatgtcatatttatcaaggctgtggtggttgtcatttaatgcatttatcaagtaaaggacaacaagaatttaaaacaaaaggagtaaaggattgtatggaaagaattggacatttagaagttgatgttcaaccttgtttaatgcaagaaaatccatggtattatcgtaataaagtacaaatgcctttaggctatgataaaaatggacaacttgttacaggtttttataaacaaaaaaccaatgatattattgcttgtaatgaatgtttgattcaaaatgaagaatctaatgcagtgattcaaagagtgaaagaactctttgtagagtacaatattaaaccttatgataaagtaacacatcgaggaaatattaaacatattcttacaaaaaaaggctatcatagtgaagaatttatgctttgttttattacctatcaaaaaacaatcaagcatattgatcaaattgtagaaatacttattcaagaatttccacatattaaaaccattattcaaaatattaatgaaagacatgataatgtcattttaggtgatgaagaaaagatactgtatgggaaaggttatatttatgatacattattagacaatcaatataaaatttccttaaaatcattctatcaaatcaatcctattcaagtagaaaaactttatcaaacagcgattgatttagctcatataaatcaagattctgttgttttagatgcgtattgtggaattggaaccattaccctttcacttgcaaagcatgtaaagaaaatctacggagtcgaagttgttcctcaagctatagaggatgctaaaaacaatgctttattaaataaaatagataatgcagaatttgtctgtgatgatgctggaaaatatatggttgagcttgttaagaaaaatacccatttagatgttgtttttgttgatccaccaagaaaaggatgttcagaagaattcttagaacatttattacgggcaagtccaaaagaaattatttatatttcttgtgatgtggctacacaagcaagagatgctaagtatttaaatgaacacgggtatacaattacacattgtcaacctgttgatatgtttccacatactttccacatagaaaatattttaagatttgaaaaaacaacggactaataaagataaataaaacatttattgtcttgattttattgaagggggtataaaaaagtaactagttgattatgtatgagtctggattttacctaaataaaatgtcagactgtcacatgacagtactttttattaggaggtaaataatgattaacttggacaaaaatgaaaactataacagcttggaagattggctagaaaccaaaagagtgtattatggcactaagactggattgcagttatatggcggtattgttgattttgacccggacaaacaaaaagacttagtaggtggagagaaaataacatatgatgagtatcttgatttgcaaatggaggcatgtgaaaaagaaggcaaagtacgttggaattttgcaaagtgttatcactatattccattagaattcaagggaaaaatagaacgtattacaggaaaggcagtttgctttaaacgtatttacgtttctggaatgtatcttgatggaacttgtttcgagggaaaagaagatcatgtttggattgataaacacggacttgaacattattcagttggagattgcttatcgttttgtgctgaaccgtatcgctacattaaaacaggaaatggaaaacagattgattttgggcttcgtcatctggaaaacataaaggaaattgagaagtatgaacttccttctgacgatgaattaatgttgcagtcgatcgatgctattatttgtgaaacatgtttatacaatgaacaatgctttggcatttgcatcaggaacgaaaaagaacttgaatatttgagaaaggatatgctaagagtagtaaaagtttctaagtcagaaaaggagtaataaagaattttttttgattgtagggtattctttatttctaacaatatggatataggtttaggagaaattcagtctatatctactagattaaatgatgaagattaattaaatcggaatatgatagaaataatcatggtaggagcaatgctcttaccatgattttatataaaaattagcttaacctataatagtattagaaagtgagaaagaaaatatgggtgttttagaaacggtttttagaacaagaaaatttgatttagatgacgatgttttgatggagtttgatgattattttgataagaaaagcaggaattataatagtttttctttagatgaagaagattttatttccttgcaaaattttgtggaggaaattaaatcaattgattcaaatagtgttgtttatgtatctacttatggctatgagattacaaatagtaaaggagaaaaatcaacatatgctgatactctttggattgatacgaatctcactatctctaaaattgaggaaattatgaaaaaatgtgctgttgcagaatctagttatgtttctgttgtaggagataatgctgaaagtggaaagaaaaatgtttggcttataaaacaagaaaatgcacaagttactaaactaactgatcaagagaaaattagtcaaatgatcatgctttattgggattgatgatttaacctgcatattagttttaattgttaatgggtgagatattgctatgtatgaaagtaaagcattttgtgatatatgtagaaaagatgtggattacggggttgaaaataggcaaatggtagcaactttaagtggaaaaacgtatagctacttaggaaaagtagcctattgcaattagtgtggtttagaagtttatattgctaaagttattgacgataatttaagtaacttatatgacaaatttagaattaaatcatgattagaaacattgcttaagagaataattgttttcgtgtagatgtcattttgaaaaaattttaatttaagaaatcatatggatttctttttcttatattcacttctaataaataagtatttgtcataaagtatagagtgttttacaataaatacaggaggaaaaaggaatgaaagtattattagttaatggaggagcccatcctaaggggtgtacaaatagagctttagaagaggtagaaaaagcattaaaggaagaggaaatagaaacactcatttatcatattcctaatgttccattacaagattgtattgcttgtggaacttgtgctaaaataggtaaatgtatttttgatgattgtgttaatgaatttgtagaaatggcaaaggaggcagatggttttatttttggaacacctgtttattacgctcatccaacgggaaaaattcaaagttttatggatcgtattttttatagtggaaaagcagcttttgttcataaaccagctgctacgatttcttcttcaagaagagcagggagtgttacaagtatggatgttttaaataaatattttagtatttcacagatgccaattgtttcttctatgtattggaatgaagttcatggaaataccgtagaagaagtagaacaagacaaagaaggattagatacaatgtatgctttaggtaaaaatatggcatggatgttaaagtgtattgaagctggtaaaaaagcaggaattgatattcctcaaaatacgaaaagaaatacaaattttataagataagatgaaaacattatatgtttctgatttagatggaacacttttaaatagtaaacaacatacttcatcttatactaatcaagtgattaatcaattagtagatgaaggtatgttgttttcttatgctacagcgcgatcttattattcagccaaaccagcaacaaaaggattaactgctaaaattcctttaattctttataatggggcttttgttattgataatcaaagccaagaaattcttgtttctaatttcttcttaaaagaagaagtggatgatttatctttctattttaaacaaaaagacttctatcctattgtctatgcttttagaaataactatgaaaaatttagttatatacctgataaaataacaaaacaacaacttgattttataaacacaagaaatgatcaaagaaaaaatcctataaaagaccatctttttaaaggaaatgtcttttatataacatgcattgcttcaaaagagcttttagaaggtttttatcatgatttaaaagattattatcaatgcttattttctaaagatatttatagccaagattggtggttagaaatcttaccgaaaaaagcaacaaaagcgcatgctatcttacaattaaaagaatatttaaactgtgataaagtagttgtgtttggtgatggtttaaatgatctttctatgtttgaaatagctgatgaaagttatgctgttgaaaatgcttgtcgagaacttaaagaaaaggcaacaggtgttataggacatcatgatcaagagagtgtagctcaatatttgaaggaaaattataagagataatatgaaagatttatattatgttttaatgtataatcatttaggtaatgtaaaacaatgcaaaactctcattaagcatggcttaattaaagtaaatggccttgttgaaacagatgctaaaagaaaaataacagaagatgattgcatagaatatcaaaatagaatactaaatagtcaaccttttacttatatcatgcttaataagacccaaggttatatatgtgcaaataaagatgaaaaagaaaaatgtgttattgatttaatagaagaaaaagattgtttttgtttaggaagattagatagagatacgacaggtttacttctactcacaaatgataaaagtttaaagaaactcttattacctcaaaatcatgtagataaggtttatttggtcgaagctaaaaggagactaagtaaaaaggataaagagatttttgctagggggattgttattgatgaaaatattcaatgtctacctgcaaagatggatatcattgatgattattggtgttatgtaacgattcaagaggggaaatatcatcaaataaagaagatgtttttatcgttaaataatgaagtggtttctttaaaaagaatctcttttgatcaaatacaattagattcttcattaaaagagggaaattatcgttttctaacaaaagaagaaagaaataagcttataaaaaaagcggctcaatgttgagtcgcttaaactttttctgtcgttaaaataacaataacagctcctacaatagataaaatgataccagcaagtaaaacatgaccaacacctaaagcatcaagcataattcctccggcgaagtttgcaaaaacaccagataaagtcattgaagtagtaactaaagattgtcctttaacgcgatctgctaaggcaattttttcattgacataataaacagaagcaggaataaagagggcataagcaaacatttgacacacctgagcaagataaatcatgatcatatttgtcgcaaaatatgtaagggcatgtttgacacagaacattaaaattgaaaacttgataagggttccacaattgattttttcagacattttagaaaagaatgccattgttggaagttccaacatagctgctacgaaaacagcatttcccatatctgcacttgtaccaccaatatttgtaataatttgaataaagaagttattaatgatggtatgagcaaaataaacaaggacgaatcctactaaaaataagatgaattttttatatttcatacagaatttaccaaaagaaagttgttcagtttcttcttgtggtgtttctacttgttcaacatcatttttaaattcttttggtaatacaaacattttaacaacaataaataataaaacagtaaataaaatatagaaaagaggtaaagtacctggagaaaaactttcaacaatatgtcctaaagctaaagaagcaatggcataagctaccgaacctaaacctctagcaagaccatagttaatttcaataccatgttgttcaaaagcaaaagcaagagaattcatcagtggcataattgatgacataattgaaaagatagtaacaactaaaaataaaacaaataaagcacttcctggaattagataaaggatggctgataatgcgataaccactaaaatgataggagccataatatttctaatttcaatatttttatgattgtcagcaaaagaggcaagcataggttgcaataaaacagcgataatacttgaaagagctaaagcaatcccaatttgtgagttagaacaacctttatctaataaaaagacagaggcataacccatcattgctgcaaaagcagcaaaataaaagatttgacttcccgcatatttcaagttcagactacggttttttttcataaacatttccttccttgattatattcgttatctttattctatcatataaacataaaatgtaagcgcttttttattttatgaaaaaattcattctcttttacctgtttgtcaactataatagatgtggtgatacaatgaaagaaataatgataattacaggagcaagttctggtatgggaaaagaatttgctagacaaattgaaaagaaatatcaagttgatgaattatgggtgattgctcgaagaaaagaaagattggaaagtctaaaagaaatattagaaacaaaagtaaaagtacttgctttagatttaacacaaaaagaatcatttgaaatacttcaggaagctttatttaaagaaaaaccaagagtgaaagttcttgttaattgttcaggctatggaaaattagatcattatgaaaatatgtcgtcagaaacaattgaaaatatgatgaatttaaatatgctggcagttgtcaaaatggtcaatactattttaccttatatgcataaagaaagtcatattgttaattttgcttcatgtagtggctacatgccaattccttatttaaatatttatgctgcttctaaagcttttgtccttaattattcaagagcattaaatgaagaattgaagtatcgagggattcatgtattagctatttgtccttattgggttgaaacagaattctttgatcgtgctgttgaaaaagataaaaagcccgtggttatccgttatggaaaagtatatcaagcaaaagatgttataaaaaaagcaattaaagatatggaaagttctaatgatgtttccctttatggaacgataaataaaatacaaatattagggatgaaggttttaccacatcgatttgttaaaaaaatttggatggcttatcaaaatttagatggaacaaggaagataagatagattgtatttaattaaaaaaatctttaaaattagagaattttttattaaagtgtgataagataaaatcagtgaaatagagaggtatgtatgatgaaaaaatttattagacaaaatatagatcatcaaccaattgttgataatgtttttaaaatcgtaagtttagcaaatgatgcaattgctaaaaaaggaaaagaaaatattgtcaatgcgacaattggttcattatatgatgaagatggaaatttagttgcattagataccgtatttaatacgtataacagtttagataatagaacaaaagcaaaatatgcttcaagttttagtggaaatcctaactttagacaacaggtttataattgggtcgtacaagatacaaaacttgatttatgtcatagtgttattggaacacctggaggatcaggagcagtaagttcaaccattttaaatgtgttagacgaaggtcaaactttaattattcctcatattgcatggggtaattataaatcaatgacaaccattgctaattgtaaagtacaagcctatcaaatgtttgatggggatgctttcaatattacaagctttaaagaaacttgtcgtgaagtaatggcaagacaaggtaaagttttagcgattatcaatgatccatgtcataacccaacaggatattctatgacagttgaagaatggaatcaagtgattgatttttgtaatgaattatccaatgaaggacctgttattatcttagatgatattgcttatattgattattcttataacttagaaagatcaagagattatatgaatgcatttaatcgtatgaatgatcaagtcatggttattgttgcattctcttgttctaaaacattaacttcttatggtttaagatgtggtggtgctgttattttagcgaaaaatcatgaagatgtaagatcacttgaaatcttgatggaaaaacatgccagagcttcttggtcaaatattcctaatgcagcaatggaaaactttgttaaagtaacaacagaacataaagatgaatttaatgcagaaaaagcaaaatatgtagatttattaagacaaagatgtgaagtctttaaaaaagaagcagatgaatgtggtttagcgtattatccatataaagaaggtttctttgtgactttaaaagtagaagatgatgatttattaacacgtttccatgaagcaatgattgctcaagatatttatacaattaaagtaaataaaggtattcgtgttgctttatgttctctttcaattgaaaaatgccaaggacttgcctttaaaatgaaagaaattttagatagtttaaaataatcgggaggaccggttattttttatggaaagaagaaagtatttatttaaaggcagagttcaaggggttggttttcgttttcgttgcttttctatcgcaaatgaattaaaattaacggggtttgtaaaaaatgaatatgatggttcggtttctatggaagttcaaggagaaggaatgcaaatagaaagaatgatagaaaaattgtatcaacaaccatttattgaaatagaacaaatccattatcatttattaaatattaaagaacatgaaaaatcttttgaaatacgatactaaggaggaactatgaaaacaattgctattgtggcaacaggtggtacgattgctggtacaggtaaaaaaggaaaaacagcagcttatcatgcaggagaaattgatattgattcaattattgaaacaattccagaaattaatgaagtcgcacatattaaagaatatcaattaatgaatattgatagtaatgaaatgacacatgaaaaatggttgattttaaaaaataacattgaagaaattttgtcggatgacacgattgatggtgcagtcgttacccatgggacagatactttagatgaaacagcttattttttaactttaacattaaatacaccaaagcctgttgttttaacaggagcaatgcgtccagcaacagcaacgagtgcagatggtccatttaatctttatcaagctatttgtttagcttgtcatggagaatcctataatcgaggtgttctagcattattttctaatacgatttattcaggaagagatattgaaaaagtcaataactttaaaatcgatgcatttgatcaaagatcactaggatgtttaggatatatgcaagatcaagaagtttacttctatacccaaacaagtaaaattcatacagtgaaatcacgttttaacaaacgtattgattccattaaaagtgtagcgattgctttttattacagtggtgcggatgctaaaatcttatatgatcttgcaagtagtcatgaagggattgttattgcgggatcaggaagtggaaattatagccaagcatggttaaaagctattgaagaactttcagaaaaaggaactatttttgtacgttcttcgcgtatttcacaagggattgtttttgatgatgaaatttttgatccacatcatttatgtatttcttcaaatacattatcaccacaaaaagcaagagttttactcatgcttgctttaacacaaacacatgatcgtgatgaaatcagagaaatctttttacaatattagaaggagaaatccttctttttttatatgtttctaattgttagtcagtattaatataaaattaaaaatgtttatattaagaataattgatagctatgatacaatttatgtttagagaaaatcaattaattttggtgaatattagatcaaaatttatcaattaacagtaagacaattttttagataaaaaactattttatgttatttattcaactttatgcattgtctggagtagaatgaacttataaagcaaagtattattttaattttatgtgaaaaagggggagagtaatatgaaaactcaagaagaatatttcaatgatttaaagaaaggtacatcattagtggaactacaaaattatattaataatgttttagaaattagaggattcaacaatcagtcaatagaattaaaattaatgttattaatggaagaagtgggtgagctagcaaagtctattagaaaggattcaacaagtttaccaattgatagatgcaaaataaataattattctcctattgaagaagaaattgcggatgtattaatagttttattttcaatagctaataaattacaaattgatttgtatgatgcatttttaaaaaaggaaagggaaaatataaaaagaaaatggaagaaataaataaaaaacaaatgtattatcttttaatatcaacgttatttcatcaatcacaaaatacaaatactacattacaaaatagtcttaaattagttgaaaaattggaaaaaaagaactatgtatgtactgaaagagaattaatggatttattttataaacaaggcattaaacacagatttcctaataaaatgatagattatctagatagtatgtttgacactttaaaatatgattttaaagatataaataatgtttttcaagtaactaattttattgaattaaaaaataatttattgaaatttaaaggaattggagaacataaagcacaaatttgcatactaaagtatatgattttgcaaggaaaaagtattgatattgatgattatgatcaaatgttaaataattgttgttccttggatgaaactttatttcgtgaaatagaaataattaagaaattaagtactagaaatacaatttaaaaattatatacgtatattcaaaaacattaactctatatttttatataaaggagaaagtaagatgaaagttttagttttaggtggtacgagattctttggtattcatttggttgatgaattattaaaaagtaattgtgatgtaacaatagcaactagagggttaactagtgattcttttggaaataaagttaaaagaattagattggatagacatgatgaattaagtataattaataatcttagtgacaaatattttgatgtaatatatgataacttggcatattgttccaatgatatagaaatattattaccacatattcattgtggaaaatatattgttacgtcttctacatctgtttacaatcctttaaaaggagatgtaaaagaaactgattttgattcaataacttatccatatattaattgtaaacgaaatgaagttaaatatgcagaagggaaacgtcttgttgaggctgcaatattacaaaaatttaatgatataaactatatttgtgttagattcccatttgttataggaaaagatgattatacaggaagattgattaagtatataaaatgttatagagaaaagaaaaatttatatgtaaataatataaaaaataagatgagtttcgtagattctaaagaagctgggaaatttctagcatttttaaaagatgtaaataattttaagggatgtattaatgctgctagcgatggggttttatcaatgtatgagattttatcaatactagagccgaataaaaatgttcttgataaaaatatttctgagttatttttaaaaaagactacagaaattgctccgtacaatgatgtagaaagttaccaaataaatactgctcttgctaaaaaattaggttttagattttcaaatattaattcatggattaattcattaattaaagaatatacaaaataaattattagttaggtaaattgggtaaaagatagtaataataacaagaacgatacatctagcacaacgatatttttgattttaaatatagagctttataatattagaaggagaaatccttctttttttagcataaagtatgttgaaattatgttagctaaagctaatggaggaattctatgaaagtttatacatttggagatcaatcaaagccagtaatgatgttgtttccaggaacatgttgttattggaaaaataattttggacatgttatagaagggttaaaagaatatttttatgtagcaattgtcagttatagtggttttgatgaaacagaacactctacttttatctctgaattagatgaaaaaaaaagattgaacaatatattcaagaatattttaatggtcatatttttgctgcttacggttgttcacttggcggatcttttgtatctttactggtaagtagagaaaatattcatatcgatcatgcgattattggttcaagtgatatggatcaaacttcgaagtttctagcaaaactacaaactgcacttgtaatgcccattatttatcctttaattacaggtaaaggaagtagactagctaaaaaatttatttctaaaagaatgaacagtcaagatgaaaatgcagattaccgaaagaaattcatggaactcatgggtataggaagtggtattgatttttcttttatttctaaagaatcaatgaaaaatcaattttgtagtgacttatatacaaaagtgggtcaacaaatccaagtacctcatacaacaattcatgtattctattcaaaaaagatgggtgaaaagtatcgaaaacgttatgaaaaatatttcaaacaacctgatatcattgaatttgatttaagacatgaagaattgttgttggatgcttctcgttgggtcaaagaagtatgtaaggcttatcagattgtttgatatttaaaataaattaaatgtgttgattaaaaaaataatcatgcttcaagtataaatacgtaatattaaaaaggagaaagagtatgaaattatattatcctgccattttcttaaaagaaaacgatggaagatattcagtttcattttctgatgttttagaagcaataacatgtgggcatgattttgaaaatgttgatataaaagaaactgttgtaaagattgaattgaatttaactggattagatgacaaaaaaactaattttataattataaaaaagagtaatgaatcaggaaaactgaatcattactcttttacgtatacagcaaagtttttatcctcacaataaaaatcaccataaccatcttcattaataagaactctttgataaccattaaagacattgacataataacaatgacgatcttctttaccaacatacattgattttataccaccagttgaattcgtcataataattgccattgcttttgtttgggtacgcctaatccaaccaattaaatgaggatgatcaaaataatcttcttgatttccttcgttatattgttttcttaaagaaaggagttgttgaagcatttctttttttgaagaaacattttcataatcaataccttctaaatcaccatagaaaacacaaggataccctgcttttcttaaaagagttaaacaataagcatgtcctttaaaccaatcaggaatgaaagaagctaatgattgacttggttctgtatcatgattatcgacaaaagtaactgcatttgaaggatacatggaaacaagcgtttgatcaaaaatatgagaaaaatcacaattttcattatgacttgcatcataaaaatgatagtgaagaggaacatcaaataaagacatttcaaaattgacttcttttaaatacttttctaaatgatacacatctccgtgccaatactcaccaaccgtaaataattctttattaaaatcgtgatatatttttggcaagaggtttttataaaaagaagcgggaatatgtttaacagcatcgagacgtaagccgttgattttagtaaaatttatataccaataaagccatgaggtaacttcttgaacggtttcttcatttccaaaatctaaatccgctcccattaaataatcataattgccattttcatcatcgacttcttgatcccaacttttttgatcaaaaaggaaaatggtattacgatgggtcttttcatcataatcaatcccatcaaaatgataccaatgccaaataaaatcagaatattttttatttctaccaggaaaagtaaaaagagtatggactttaatttgttcatcaccagaaatgatttcattagtattttgacgattgacttcttttgcattaacaatttcagtaccgtcagcgcccattttatgattcaagacaatgtctccatagacatcgattcctgctttttgaaaagcttgaatacacgctaaataatcttcttttgttccatattttgtttcaatacttcctttttgattaaattctcctaaatcataaagatcataaacaccataaccattatcatgaataccgccaacgcctttataagcaggtggtaaccaaatagctgaaaaacccatttctttataagattttactttttcttgaagttgtttccaaagtttctcttcaggttttatataccaatgaaacccttgtaataaaacaccattttccatttttttcacctcattgaaactattatacatcattttatttcattttcctaaaagatgcgttaaaataaagaaaattagggggattatatatatgtatgaattaatatcaaatttaattctttatgggaatttaccaaaggatgaaattttagtacaacttgctaagttgttatcagatgatgaaaaatcaaatcatgaacttcgtcaagaaatttatggtcagataaaaagattattagaacttgcaactcaatatggatttaatgataatttatggcataattatttgacttatttattaatgacaaatgaaaatccatttagtatgacttgtgaaaaacaaggggcaagagaaggtacggtcaatcattttgctttaaatgattttaaagtgttctatgaattatttcattatgattttagtacaatagaaaaggaattaaatattgattgtttttcaactcttgctaattataaagctttatcaaaaccagaattgatgtacaacaagaatgtttctttaaaagttcaagaactttcaaagaaactagaagaaacaaagaatgaacaagaattctttgatgttgtaacacaattctacaaagattatggagtaggtatgtttggtttaaataaagcctttagaattgcgacaagtcatgaaaactatgtagaattaaaaccaattaataatatggatgaagttgttttagatgatttagttggttatgaaattcaaaagaaaaagttattagataatactgtagcttttgttgaaggaagaaaagcaaataatgttttactttatggggatagtggaacaggtaaatcaacaagtattaaagcaatcgttaatgaattttatgatcaaggtctaagaatgattgaaatctataaacatcagtttaaagatttatcaaatattattgcgatgattaaaaatagaaattatcgttttattatctatatggatgatttatcatttgaagaatttgaaattgaatataaatttttaaaagcggttattgaaggtggtgttgaaactaaaccagaaaatattttaatttatgcgacaagtaacagaagacaccttattaaagaaaactggtcagatcgtaatgatgttgttcaagaaaatggaatgcatcaatcagataccatggaagaaaaactttcattagttaatcgttttggggttaaaatcaattattctaaaccaatgaaaaaagaatttaatcatattgttttagaattagcacataaaaataatatagaaatggatgaaaaagaattattattagaagcgaataaatgggaactttctcatggtggaacatcaggaagaacagctcaacaatttatcaattatattttaggattggagagataaaaatggatgcaattgaagcacttacaacaagaagaagttgtcgtagttttaaacaagaacaaatcaaagatgaagaattaaaaactatccttgattgtggtttaaatgcccctagtggaatgaacaaacaatcaagtaaaatcgtggtagttcaaaatcaagaagaaatcaaaaaattatctaagttaaatgctttcatttggggtaaagaagcagatcctttttatggagcaccaacagtatgttttatctttgtcccaaaagatgaaagtaatggtataaaagatggttcattagtgattggtgctatgcagacaggagcttatgcattaaatataggttcttgttggatcaatcgttgtaaagaaatgtttgaattagaaaaaggccaagaatatcttcgaaaatggcatttagaggattacgttggtattggttgttgtattttaggatatgttgaaaaaacattacctgaaaagaaaattttagaaaatcgtattattcaaggataggagaatgaatatggataacaaaacttatgaatatgttgaagatcgttcaatgacgatacaacaatacattaacaatatttttaaatggatggttattggtgttttaacaacttttgtgacagcttttgctttagaaaaatcatcatttatgtcttatgcaggaatgcttcctttcattttaattatttttcaatttgcggttgttattggtttatcaagacgtttaatgacaatgaaaccaattacagcaaaagttctttatatgatctattcagtcattactggtgtgacattttcttatgttattgcaagctatacttcctttagcgttgcacttgcttttttagtagcagccatctactttggtgtgcttgttgtactaggaacagtgattaaaatggatctaacacgcattggaacaatctgtctagtaggattatttgtttatattattttttcagttattgtgatgatttttaatttaggtgtgggaacacttattatgccactgatttcacttgcattatttgcaggaattacagcatatgatatgcaaaaatcattacaactttataattatgcttcatctaatccagaaatgttagaaaaattaagtattcatggagcatttaatctttatttagactttgttaatatcttcttagatattcttcaattattaggagataataagtagtcaaaagagcgaaagctcttttttttaaatgcataatcgattataatatcttttacacataggagggaatatgaaaaaactaattggaagtaaaggattttataaaatggttcttgcgatttgtatacccattgttattcaaaatggttttacaaatcttgcaagtttattagataatattatgattggacaattaggaacactttctatgtcaggagtttctattaccaatcaattattacaagtatttaatgtcacgatttttggagctatgtcaggcccaggaatctttatggcacagttttatggaaagaaaaataaagaaggagtggagaattgttttaggatcaaattgattataggaattataattgcactgctagctatttttttattctatacatttggacaacaattgatttctttatatttaaatgataatcctactgatagtttaaaaactttaaattatggaatggattatttaaaaattatgctcattggactgattccttttgtaattacacaagtttattcatcgtcacttagagaaacaggaaatacggttttaccaatgattgccagtgtggtcgccgtgattgtcaatttctgtattaattatattttgatctttggacattttggatttccacaattaggagttactggtgcagctattggtactgttgtttctcgtgtggttgaaatgagtattaatattgtaggtggataccgtaatacttatttaaaagaagcgatggtgttaaagaaagtaccactttctttaacaaaagaaatgttgaaaagaggattaccgcttttatgtaatgaaattctttggtcaatatcaatagctttaatttcccaaagttattcgacaagaggaattatagcggtagctgccattaacataacaacaacagtaacaaacttctttatgatcgtatgttatgctattggtaactctatttctattgtagttggtcaacaacttggagcaggagaaattgaaaaagccaaagattacgatttaaaaatgttatttatgaattttgtgatgtgtttggctataggtattgtattattcaatgtttcatcactcataccacaaatctataatacttcattagaagtaaaagctttagcctctcaacttttaaaaattgcggcatgtatgttaccaattatttctatttattatagtagttattttacaatgcgagcaggaggtaaaacttttctaaccttcttatttgatagtggttatacttttgtttttactttcatgagcgctttattacttacccgtttaacatcattaccaatattgactatctatctactagttcaatgtgttgatattcctaaagcaacacttggtcttgttcttgtaagaaagggtatatgggtacataatattgtaagtgatctctaaaatattttttttaaaatgaaaatatgatatattttctttagagaatccatgctttagttggattaaatcggagaaccagagccatagttggataagcagagagatttctctgtttttttatataataaaagaggactgttgaagctataatttagcttttcagtccattaaaatatgttattttttcacaatacgataataagctttagaagtgattaaataaacaatcgtataaataataattaaacttataatacaactgattgtagaaataaaatagacattttcattacataacaataaaccgtttaatacctttaaaataagcggataagcaaataataaatgaataattgcaacaattaatgggacaaagaagaaaataagtacttgaaactggattgtttgtttaacttctttttgtgacataccaacattttgtaagatttcaaatttattttgatcttcaaatccttctgatatttgtttattgtagataatgataatggcagctactaaaaacataattgataagaaaataccgataaagagaatacttccatacatttcatagataaattcttgatcttcaatcccattttgagtagtaaaataataattcttttcaccaagttgactataatctatttttataagttgatttgtaacattcttaacaacttcttttgatgcattgaaaccaataaagaatatttgtggttttaattgatattgatcaagattattttgattcataataatagttatagcattaaaagcataactattaccagtttgaacttgacggtttttgatttgatctttaatgacataagaattgccatttaaagaaagagaacggtaattatattttccataactatagagatagatttcatttttatctaaagaaaggtttttatcaaaataatgattataatcttctaaagaaacaaggttgatgcaagaaagatacttataatcataatcatcaagtttagcatgattcttttttaaactcccagaatactcataaacaggtaaagcataaagagaatcatatttttcatcttttaataattcttttgttttatcaaaaacataacttggatttttaaaaccattcaacttaatattaccagccatataacattgacggtctatactatcttgaattccattatataaacagattgttgaagaaagagtaaccaaaacacaagtacataaaatacaaatatttgctagtccgattgcattttgtttcatacggtataaaagaccagaaatagaagtaaagtgtgttggttgataataaaagtttcttcttgattttaagaattttaataaagcaatacttcctgctgtaaataaactataagttcctagcatgactaaaataactgcaacaaagaacaaagtcattgctttcattggatcagtgatagataaggcaaggtagtaaccagcccctaaagtaatcattccaaaaagcgttaagattatttttgttttaggttctttttcaccaatgttttgtccttttaaaagttcaataggattacttcttacaacaatagtaatattgtatattaaagaaattaagaaaatgatactaaaaacaataatggtttgtataaaagcgttcaatgaaaagtttaaagaaaattgaacacttttatgaatcaatcttaagataataaccgatgttatttgcgaaagaagaacacctattaaaatacctgatgtaagagaaataagggcaataatgagtgtttctagaaacatcatcgaacgtatatttcttttttccatccctaagatatgataaagactaatttctttttttctattttttataacaaaactattggtataaagtaaaaatataaaagagaaaatacttattacaccactgcctaatcctaaaaacatcgtcatttcttgatgatcttttaaagtaggactttgtccaatatttctaacaataaaatataaggcaatagaaaagattgttgaaacaaaatatgatgtataaagcttcttattctttttaatgtttcctaaagccaatttcaaataaaatttcatattattgacctcctgaaagaagcattgttagagtatcactaatagcttgatacatctcttgatttgtcatgtctcctttataaagctgatggaagatttgaccatctttgataaataaaacacgactggcataactagctgctttactactatgagtcaccattaaaatagtttgtccactttgatgaatttgatcaaagattgataaaagctgatcagttgatttagaatcaagagctcctgttggttcatcggcaagaatgattttagggtttgttatgagggctcttgcgacagcaactctttgtttttgaccaccagatatttcatagggatatttttctaataaatgatctattcctagaggtttagctagtttgtctagttttggtttcattaaagcataaggctctttggataaaacaaggggtaaataaatattatcagcaacattaaaagtatctaataagttaaaatcttgaaatacaaagcctaaattatctcttctaaaagctgaaatatgtttatcagagattttagtaagatcttgattatctagtaatacttcgccacttgttggtttatctaaagaagctaaaatgtttaaaagtgtcgttttcccacttccagattcacccataatagcaatatattcaccttcttcaacgtcaaaagagacatcttttaaagcttctaccttttgacttgaaaaacgtgttgaataaattttttgtaaatgtttaacttgtaataatgacatttttgtctcctcctttttacacctatattctatgcttttaataaaagatgacctatcgatttatcttacaaataagcaaaataatcttacatttttgtaagattattcattctatataatttcttgaaagccttgatattttttttttatgtttttacatactattaatcataagttcaaattgaaatgataattttattctatatggaggggaaaagatgttacaaataacagatatctgtaaacagtataaaacgggaaattttattcaaaaagctttagatcatgtcagccttaatttaagagataatgaatttgtggcgatacttggtccaagtggctctggtaaaaccacacttttaaatattattggtggattagatagatatgacagtggagacttaattatcaatggtatctctacaaaaaaatataaagaccgagattgggattcttatcgtaatcacacaatcggttttgttttccaaagttataacttaattccacatcagacaattttatccaatgttgaacttgcgcttactatttctggtgtttctaaagcacaaagaagagaaaaagcaattgatgctcttaccaaggtaggattaggacaacaaattcataaaaagcctaatcagttatcaggaggacaaatgcaacgtgttgctattgcaagagcattggttaatgatcctaatattttattggctgatgaaccaacaggagccttagatagtgaaacgagtatacaagttatggatttattaaaagaagttgctaaggacagacttgttgttatggttactcataatccagaacttgccaaagaatatgcaacacgtattgttacattaaaagatggagttattttagatgatacaaacccatatcatgttaaaagttttgtcccacaacatcgtaatatggggaaaacatctatgtctttacttacatcactatcccttagttttaataatttgaaaacaaaaaaaggaagaacttttttaacatcttttgcaggttctatagggattataggaatagctcttatattatctttatcaaatggtgttaatacgtatattcaaacaattgaagaagatacgttgtcagaatatcctttacaaattacaagtactggtatagatatgtcatcaatgttagtagatgatagtcaagataaaaaacaatcttctaaaaatgatattcaagtagctaatatgatgactacaatgttttctaaaattggatcaaatgatttagaatcattaaggagttatattcaaagtaatcaaaaacaattaaaaaattattccaatgcaatcgaatatacttatagtgtgacaccacaaatatatcgctatcaagataatacttatagacaagttaatcctgataaaacatttagttcactaggaatgggatcatctacaagttcaaataatatgatgtcttccatgatgtctacagatgtctttaaatccatgcctaaaaataccaacttatttagtggacaatatgatatgaaagcaggtcattggccaaaaaaatataatgaatgtgttgttgttcttacttcctctggaaagataagtgatatgatggcttatacacttggtttaagagattcatcagaattagatcaaatggtacaacagtttgctaatgaagaagatgtagatgtgacattaaaagaggatgattatagttatcaagatattttaaataaaacattcaaacttgttaaatcggcggattattatgaatatgatgaacaatatcatgtatataaagataaatctaatgatcaaacatatatgaatcaacttgttcaaaatggtgaagatttaaaaattgtaggcattgtccaacctaaagatgaccaaacagcgaccatgttatcaacaggaatttattatccatcatcgcttgtacaacatattatagaaaagtcatctacaactcaaattgttcaagatcaattaaaaaataaaaatgtgaatatttttacaggaaatgcttttgaagaaaaaaattcacaatttgatttaagttcattatttacaattgatcaaaacaaaatgcaatcagcattaaagttcaatacacaagctttacaattagattttacgaatttaaatcaagaactgacaaatctatcacttccaacattagacatgaatcaaataattaatcaaattcaatttaatgtttcaagtgatcaacttcatcatttagctaattctttattaaatggttatttagaatatgaaaaaaatcatccagaagtaaatattaatcaagctacacaagaatttataaattacttacaaacagatcatgcacgtcaagttatagaagaacaagtaaagaaatatattgaagatggtattgatcaaaatgaaatgcaacaaattatcaatgcagtcttagacgattataaaaaacaattaggcgcaaatgatttagatattacaaaaataaatgagtatttaatgagctatttaaattctcaagaagcaaagaatattttaactcaagaaatgacatctattatacaatcaacaaacatagaaacacaaatttctcaaattatgtctcaatatatgcaatcatctatgcaaaatttatcatcctctctacaaagaggtattcaaaaaagtatgatgtctatgagctcttcaatggcaaatgcttttcaatttgatagtcatgcttttgcagaagcaatgagctttagtggcgatgaaaatgattttatgagtattatttcatcaatgatgacaagtgaacaagattcatatgataataatataaagaaattaggatatgctgattttaaaaaaccagcaagtattagtatttatcctaaaaactttgaaagcaaagaaaaagtgattcactttttagatacgtacaatcataaaatggaaaaaacaaatcaagaagaaaaagtcattacgtatacagattttgtgggaacattaatgtcttcggtaactgatattgttaatgtcattagttatgtccttgtagcctttgtaggtatttcattggttgtttcttcaattatgataggtgttattacgtatattagtgttttagaacgtaaaaaagaaattggtatattaagagccataggggcttctaaacgtaatatttcgcaagtattcaatgctgaaacatttattattggcttgtttgcaggtcttattggaattattattacattactcgctcttatcccagctaatattgttattcacaatattgcagatacaacagctgttaatgcttctttaccaccagttgcaggaattgttttaattattttaagcgtgattttaactctacttggaggaattgttccttctaaaaaagcagcgaaagaagatccagtaactgctttaagaacagattaaagagtctttctattagacttttttttctttagatatataataaaatcaaggagtgaagattatggtaaaagtagatttaataacaggttttttaggatctggtaaaacaactttcataaaaaaatatgctcaatatttaattgatcaaggatatagaattggaattattgaaaacgattttggtgcagttaatgttgatatgatgttattacaagatttagaatcagaaaactgtgaattagaaatggtagcaggagcttgtgataaggattgtcatcaaagacgttttaagacaaaattgatatctatgggaatgagagggtttgatcgtgttttagtagaaccgtcaggtatttttgatgtagaagaattttttgatgttttacatgaagaacctcttacaaattggtatgaaataggaaatgtatttgcaattgtagatgcctcattagaaaagaatttatctaaagaagcctcttatttacttgcaagccaaattgtaagtgcaggaaaaattattttaagtaaagtagatactacaagtaaaggaagaattgtagaaacaattcaacaaatgaatgatgcacttgctttatttcatggaaaacctcttccaaaagaaagattaaaaattaaaaaatgggatgaaatgacccaagaagattatcaagaattattaaatagtcaatatacaaatgattatattgaaaaattatggtttaaccaaaatgatgcttttcaatctctttattatatgaataatagattcaatcaagatgaatttattcaaaaaataaatcatatatttaaagatcaagattgtggtcatgtcatgagagttaaaggtttttatcaaaaagaaaaacactggtatgaaatcaatatgactcaagaagatacctctatacaagaaatcaatcaagggcaagatgtcataattgttatcggtgaagaactaaataaaaataaaatagatcaatattttaaatagagatgtcaaaatctctattttttgttagaatgaatccaagtaggtgaaacaatgaaaattataaaatatttattactgatattttttatcataagttttattatttttttacttccttttttattaaaaggaatcttaaatattggaaatacagcaggaatgatagtttctttaggttgtttccttattatcttttttaataagccattacatcatttgattttttctaaaataatattatctttcataatcatccttttagcaattatttctacgtgttcttataaaatacttacaaatatgaatatattacctcaagaagaaacaacagttgttgttttaggatgtcgtgttaaaaataaaaaaccaagtcttgcattaaaagaaagacttgataaaacatatcaatatttaaatgaaaatcctaaattacaatgtattctatcaggtggacaaggtgctaatgaagaaatatcagaagctaaatgtatgtatcaatatcttgtaagtaaaggaattgatcctcatcgcttatatcaagaagataagtctacttctacaagagaaaatatattgttttcttatcaattaattaaaaaagaaaatttacctaaagcaatcacgattattacaaatgaatttcatgaatatcgtgcacaaacaatagctcgtcgattaaatatcaaaagttatgctataagtgctcatactgcttggtggttatttcctacatattttgtaagagaaatctttggcattgtttatgaatttattttttaggaggtaagattatgggaggaataagtgtgttagtagttttaggtttatttatgtctttttatgcgttatatctttttttgatctttatcagcatcttttatcttgttgaaaattatatttttgaaagtctttttctttataataaaacacattcaaagaaatcatggattccttattacagtaaatatcttctaggaaaagaagtagcattggaaaaggaaggattatttttaatgatgattgaaattatgggaacaattcttttttatctctctttaaatgttcaattaggttcattagatacaattatctttttattatttttaggatgtgttttactttcttttattatgaatatttatattttacatcaaattataaaaaaggtttatcctaaatatggagattggatcactgttttcaatgttttaacattgggattttttagatctataagtttattccttgttagaaataaataataaaaagactatctttttttaaagtttgtgataatatattacacgaaatatgaggtgattgagatgaaacaagttgttttagaatttgatgatgaagaaatggaattattagaagaacaatttaaacaaattcaagatgttgctggaatggaaacaattgaagattatatatattatgcgacaatgtcacattgtaaaacaatgcaagcagcatcaaaaatgtttggacaatcaggtgatattgaaaaacttatggctgatgaaaatgttcatgttggtgttgtaaacatgcctattcaattatctaatgtagaagataaagatgaatttagtagatatttaaatgatgttttaaatgatgccgtaaaagacttcatgaatcgtaataatgagccactaaattaaaaaagcacgtgagtgcttttttaaatatcttttactttttgagaaaactcatcaaaccaatcagaatgataattttcaacataaccttgatcagataattgagtcaattcactatcaataggtaattgaccaagtaatggaagttgataacgatcagccacttcttgactatgactcttaccaaacatataaattttcttatcacaatcaggacatttaacataagacatattttcaacgataccaataatatcgacatccatttttttagccatattaacagctttacttacaatcatccctacaagttcttgaggacttgtcacaatgattataccatctaatggaagtgattgaaaaactgtaagtggaacatctcctgttcctggaggcatatcaacaaacatataatcaacatctccccacattacatcagaccagaattgtttgatcattcctgcaagtacgggaccacgccaaataactggtgtatcatttgattctaataataaattcgtagacataattttaattccttgactactttcaacaggtgtgaattctttaccattagataaaacttgtttgttttctacgccaaaaatacgccctatagaaggtcctgtaatatcaccatctagaatagctactttatatccttctctttgtttagcaagcgccaataatgaagttactgaagactttccaacgcctcctttaccacttacaacaccaatcactttttttacatgagaatgtgcattcattggtgctaaaaaatctttttttgaacatgtacttttacatgaattacaatcatgattacaattagccatactactctctcctttaacctctatacattataacctaaaatcaaaaaataaaaaaataatatgattgactttatattaaaaactcttaataattaaatctatggaggaaatttatgaaaaatttaactacaggtcattctttaaaacttatctttttctttgctttacctttaatgttcggtaatcttttacaacaactttatatcatggtagataccatgattgtagggcgttttgtaggtgttgatgcattagcttctattggtggggcagattggatcaactgggctattttaggacttttaatgggctttacacaaggattttcaattcgtgtatctaattgtttaggggctaatgatgaaaaaggaatggaaaaatcaattgcgatgtcctatctttcatgttttgtaatagcaattttagttatcattttttcacaaataattatcgaacctttattaaaactattaaatacaccaagtcatacaattcaaggatctattacctatttaagaatcatgtctggtggagctttaattgtaatcttttataattgtttttcaagtattttaagagctataggagatagtcgtacaccgcttattgcaatggtcattgctgcttgtttaaacgttatactcgatttattatttgtttgtatctttcatcaaggaattgctggtgcagcaatagcaacattgatttcacaattatttgcagctactttttgttattttaaattaagaaaagaattaccctttaaaattaaaaaagaaacttttcaaatagatcaaaaacttatttatcaactcattaaattaggtttaccattagcttttcaaaacttgattattgcttttggtggaattgttttacaatctgtagttaatgactttggtttcttatttattgctggttatacagcaacaaataaactctatggaatattagaagttgttgctatatcctttggttatgcaattacaacctttgtttcacaaaactatggagctaaaaaatatcaaagaatgaaatccggtgtttttcaagcaaatattttatctgtttttatttccattgttattatgatcgttattctattctttggtaaaaaaatattattactttttatatctacgacaccaaaacaaacacaaattgttttaaaatatgcttatgattatttatttacaatggctgtttgtttaccagttttatatatgttatattcttatagaagtgctcttcaagggatggaaaatacgattattccaatggtatcaggaattgttgagttaattatgagagtatcagcagcacttattttaccgcattatatgggtgtttatggaatatatttagcagaggttcttgcttggattgctgctgcaatcatgctttatattttttatcatatagatttacatcaattagataaaggagttatgtaatatgggttggcttatttttatgtggtttgtcattttaattgtaatgcttattctttattttatcatgattgcatttaaggtaagtaagttatatcatgatatagaaaaaagacaaaatgatgattttgaaaatatatcaaagtttaaagaaaggatgatgaaataatgttaggaacattatatgttgttatatcaagttcaaaagaagaagattatcaaaaagtaaaagaggaattattagaaatctatcctgatttttcagtatctccttacaaagaatcacaaatggaaaaagatgctgttgaattctttgcgacttgtcaaataacaaaagaaaaagcacaagaagttttaggtcaattaaataatgattgggatggagaagtagatgattgtattgcttatggatttaatacaaaaatgtttgattctcttgtctatcatttaaattttcaattatacgattaaaatggatgccatggcatccattttaatttgtataaattcctgaaacagtaagcgtactagtacctacaggaatagctaaattaggaattgtaagtgttgttccagtaacataagttgttggatcatagataataggtgtaggtgaatcaggtgttgttagagaaatactattaattgtatatcctgttgggaaaacatcactaaatgaaacatttgttgcagtttcattaccattattgataatttggaaagtataaacaagtgtgtctccactataaatactagctttatttgctgatttggtaatatctaatgatacataatttgcaagttttacagaagcgctaggatttggtgtgacagcaacgataggaccagtggttgatccaccattggctgtaattgtttgtgtatttgtaagcacatctggtcttgttgtaggtgtcgttgtttcaaaaataataagcacattatcattaggatttattacattatcaatggtaaaaataactgtattatttgttatttgtacgtttacttcaatcggtgtaccatttaaataaccttctacactattatcaacatattgagtgagtcctttagctaaatcatcgacaactgttaaattataaagtgaagcacttcctgtattttctactcttgttacataagtgattgtttgattaggggtataagtatcaagaagtgcttctttagtagcagttaagtcatagagacttaatatttgagttgttactgtatttgaattagttgtcatattgttgtaaagcaaagtggcttgattggctatattgtccataaataacctcctttcattgtactatatgaggaattaaaaaaagatgtatggacaaaagggcatagaataattattatttttgtgatagaatttcaagtaatttaaggaatcgaggaaagatatggataagaaaaaaaggttatcggatgatattgctgagatgctcctttcgatgatcgtcgttgaaaagaaatatttaccaggagataaacttcctaatgagattgaattatctaaagaattaggagttagtcgtattacattaagagaagcgatacgtattttagtaacacgacatgttttagaaattaaaagagggaaaggaacttttgttagagaagattatgatgttcaaagttatgaaaagttcaatatacttccagaagttaaaatgggggcagatgatctttatgaaattcgtttgatttttgaaccagaaattgcttattatgcaacccttcgtgcaacagataaagaattagaaagaattaatgctttaaaaaacgaaattgaagaatgtattacaaataaaaaaagttatgcaaaacaagaaatgttatttcactgttctattgctcaagcaactcataatgaatttatgtctaggttagaaccagtacttcaagaatctattcaaaaaggggtatttctttatgaatatgaacatgtttctaatcaaaatattatttcagataataaaacgattatggagtttatgaatgcaagaaacgctgaaggagctaaaagtgctatgcgtattcacatcttgagggcaatcaatcaattaaagttagaaaagaaataattgatgattgttaaaaaaatatttaaagagagcagacaacgctattgacataagacaacgttagacgtataatgggtaacgaaaaaggaaatcgagtaataaaaattaagggggatattaaaaatggcaaaaattttttatgaatcagattgtgacttatcattattagatgggaaaacagtagccatcaatgaacttttttcaattataccttccataaaatatacctcctactatatatatcgtctctttttttgcttttttctttaaaaaaataaaaaaaattacgaaatgttcgtaatctctataaatcatttaatcttgctttaataaacatgaatatatataaatatttttttgcctctttttttgtgttaaatgaaagatccttttgattaatatacttgatagcattattccattcatctaaagaataatcatctattgaaaaaaatagaatcttatttacttgcacataagtaaaagcaatattatttcgtaaatctgaaatataatttttatcagcagaaattcttattttttttaacagttctattttttcgttcatcattaaatcctttctaaatagtggaaaactatattaaagagttagtatctttaatatagtttgggaagaagatataaaaatatctaaatgttgatgtctaacacatcacatgattaatatacactcattaagagcttaaataaagagattagctaaaggctgtcacaggtttcatttaatgttacataatgcctaataaaaagaaaagtgaggtctttatcctcactttaaggctatgccttttgtttctttaataaatacaatccaataatagctaaaacgcaaattcctaaatataaaccaatatttgtattatctccagttaatattttagataacttatgttgagttgtatcatttttaactgttgttataactggtacataagtattagtaatattcataccatcaatagatgtattatatcctttaacataatcttcactgattgtataattgatttcttttccttctttatattttaaaagatttccaaagtcatatgtccaatcttgtgattttgaaacatctaaaaatgcaatttcttttccatcagcatatagacgtactctaatagtatcaggtctttgatgtgcttgatcatgattatcaatccaagtcttagttcctttaagatgaacagtttcaacatcatgactatttgtaataatataaccatccttttgatttccagtaatacctactttatatcctttaacttcgtcttcttgaactgtataaacaatttcttttccatctttatattgatttaaatcatcaaatgaactaatccattgattatcatcacttaaagttaatgtttttccagtatctttaccatcagcgtataaatgaacaataacttgtttagcacgtttaccatcttgattatcttgatcattccattcttttgttacatttacacttgtttttaagattttatgtgtatttgtaatatcaaaatcattaatttctgtagcataacctgctacttcatcttcaccaactgtataattgatttcttttccttttttatattttgaaagttttccaaaatcatatgtccaattagaatctttatcaactacttttgaggcaatttctacaccatcagcatataatctaacagtaatattttcaggacgttttccatcttgatcatgattatcattccatgttttagttcctttaactgctactgtttcagcatcatgtgtattggtaataatataacctttatcttggctacctgtatatcctatttcatatccattcactttttcttcttttacagtataattaattttatttccattactgtattgatttaaattaacaaatgaatctttccaatgattagtatcacttaatgttagtgtctttccagtatctttaccctcagcatatagatgaacaataacttgttttgtacgtttaccatcattattgttattatcattccatactttttcaactggtatcgtaattttttcaaccttatgtttattcgttatttgataactctttgtatcttcatcataagcaattgttttagcataatgagcaacatctacttcatctattgtatattgaattacttgtccttgattatcatattttggcatatcaacagaccatttccaattattatcttttattacagcaattgttttaacaactgcatcaccatttttaatttgtattccaatagaatttggacgtaatccatcgtaatcattactatcatcccaaattttttcaccactaatatgaatagttggttcaattaaacctaagttttgatttggtaagttatattcatattgtccgttattaatcatttcttctttaaaaggcattgttagattaggaattgatcctgttacaattctttgatctgtttcactttttgtaactatattatcagatgtaacttttgaactttctttatcactaccttgattagcaattgttgattcatatttttctaaagatgtttgatcagatgattcaaaaacaactgtatattcaccttcaggtaaaccttcaaatttgtaatgtccgtttttatctgttgtaattgttgttggatgtgtaattgttttataaatatctccatcttgtacaacttcttcataagcttcaaatgattcatagcaatcaccatttttcttaagaataatcaccttaacattttctactcttttttcaccatcttccaatttaccatctttatctttatcaatccaaacagttccttctaatgaacgtttaacaacatctacagatgcatcatcactaagcaaagtatcttgatgtaatgtagaaattgaattaagtaaatgatctccttctgcagcaatagcagcatattccatttttaatttaaaagaacaatttccttttaattttttatctttataagcaataactgttggccatgcaccaatcaagtccttacctttaattattacttctccattttcttcaactatttcagcctttttccaaccattttcttctgtaacatcagatgcttttattccatctgctttttttcttccgtatttttcagcattatttgtataccaaatttcaacatcatttatttcatcaccaatagctgctttatctaatgttaaccctgttaatttataaattcctttcatgattgttccatcataaccatcttgaggcattgtatcaactgcaaaaacatcatctcttgcattagaatttacattacttaataataaattaaaatctcctttatcttctagttctaatacagacttacctgttttacctaaataaaattcattatttttattaactgtaattgatgttgtaacttcattattattataagttgtaaacggtcttttatcttcatctgtctgtatattaattgtattttgtaaaacatcattattatttacatcttgattaagatctgttgtattaccaattttacatgaataataaagtgatggtaaagttccattaactaaattaacttttttaattttccattttaaaacagtttttccattttcatttgtacttattgtaggttcaatcgcttttccaccttctaccttaccttctttaggaaattgtgatttatagtttccaccccaatatgcactattaggtatataagtaagaccatctggtaaagtatcttctaaataaactgttgttgtagaaccctctggaatagttacattatcccaaaaactcattttactatcaattttataatctacatatctttcattagaagaaacattataaaattttcttgattctccattactcttttgagctacttgttttgtgatacttgttgtatatgggacaacataaataccatcagcaaaagtaatattattatttggagttactttatctgaataaactccattttcataagttggaacagtatattcatttctatagtcaagtgtagcatttgaaggatttatatttttaaatagttcatctggttttttcccttgttcagttttatgccaaatccattgtttccaatcttctgaatttaatttttcaccatttgtttttcctctatattctctaacatcttgttcatatgcttgcatatcactaatactccacgtgttagtaacagcggtaaccatgtatacttgatctgctatatttggatttttctttaaatttgatgtaaattgcgtaagtaaattgacatcaggtttacctttttttattggacaacctctatattgcacataaacaacatcacaacacgtttgtttacgaccattattcttcaaatcatccttcatatcttcaagactatcataaaatttaaaatcacttaaatttttagttctcatagattcattagttaaagcttccccatcattagaaataccatatgatattttacatttgtagccagtatcttctcttgaaaaatttttcatctttacttcatcaaaagcatttctattaaataaaacaagttgatctatagctactggataattattaatattaccatcttcagaaataatattcatttgatcatagcctactgtaaatcctaaatcagttgctccaacagcagcaatatccccatctacgttagtaaatttctttccaggagtatattcatcagtccatgtttttttatttgatgtagaactgtaaaaaatactttgatttctactacctggacttgtattatcccaatttgatgtttgtttattatcatctcttttagtttcttttgtagttacattatcatcaacttcagaatatgcattcatattgatgactttagctgttgcacttatattagtttttcccgttatatcaggattgtatgatgataaagatgttgtttcattgttattaggatatactacttgaaattgttgtgtagagaaaacaccttctaaaattgaattaatatccccatttgaataaccagtaggcatattttcatagccagttgggaaatgattaaaatcagtatcatatccagtaacttcaaaatgtaaagtcgtaccctcttgtgtaactgtataatttccactattactacaataaatacgattattagcattaccagaagcatttttatttgaatatgctatatcagttactgcatcgccatctcttttattttcacacactctatataataaaggcgtaaaatcactagatgcatttataccatttacagtaaattcacttaaatcaacatcaaatttaaatggttttgttggatcaggtaattcaactcctctcattccattacctggttttcttacttctaaagcaacaccataattaattttgtatcctttaatatctttatcttttccttttaataaaggattatcataataacctgtatgatcactatcaaaatcatattcagcaagttttattgtttcagttttcttttttaaaacgatattgtacattggggcagttgtaacaataactggtttcatattatcaacagtagacatatgatttttatcattatctacataaacattaattgttggttcaattgtatcatcttgatgtttatttttaatttgtaaaccaaattctacaccaatagctccaccattatactcatttacatttaattcttttgaaatcgtatagattttattattaccatcaatgactggttcgggtattttatccgatgttacagtttgtgttgataaaactaattcatcatcatttggaataataaattcataagtaattgtatgattgacattacctaaattttgaagagtcgtattgaccttatatgtaacagtatcaaaagaacatacgatatcatttgcttgagaattatcatagcccctattttctcctgtatctttgttataacataactgatttaattcaggcgttccattatctcctaaaccacttaatattccattaccataaacagtaccatcattattttgtaataactttgaattaacaatgacacctgattcctcggcaaatacacctacttggaatgttgcaactgcaatacataaacatattgcaaaacaaaatattcctctaaactttttaaatatttttttcatcttttacaccttcccttaatttaaaatacaaaaagccatttacaaatcctattgcaactggctagcattttaaagcccctttagctttgcgtcataacctttcgattactttgcttaatatatctaactacgcctataatataaaatatattttaataaaaatgaatactattcattttccttgtcacaatttacatttcttgtaacaaaaaaggagtattgctactccttatgcattaatatagaacatatatattttttagcatctaaactattattaaattctttattttgattactcacatattttgctgcatcgttccattcttttaaagaataatcatcaatattaatttcttcaatttcatgaaattgatagaaagttaaataacgattacatgctaaatctgaaatatagtcgctattagtaataaatcttattctttctaataattccatccctaaatcctctcatatttacatgttttgtatagaaggtgttaaaaattttaattatgatttgtaaatattttaatattcatttttattttttaataagaatatgcccattaatgatgtaaccatcattaatataatgaacatataagatgtttgatcatctgtttgaacagattttctttctatatttgatgataattgtttatttgtctgatcatctccttgtatcacatcatgatgaaattgatcttctatgtatctatcttcttcaatagaagatggatctttgcttccatctaaataaggtaatgtataatgaagtggatttccacattcatttctatatacatttcctaaatctgtaagtacacctaattgattttgatttgatgtatctttagtattatagaataaagcacttgatgcactttgtaactgcgtagcatcaaaactgaaccaagcatatctttctacaaaagaaagatcatctagtccttgaatatcatcaaaaccattaataacatatttcataaattcttgaacagctttattatgttgttcatcatttccatcatatggatgccaatattcatttgaatcccaagctgctactgcaaattctgttacccaaataggtttttgataacaatcataaatatcattcatatatttcaaaaagctttctgctgcttttttaggtgtatattcttcactatctaacccaacatatccaggataattatgaacagcaataaaatcatcttttatttctagccgattccaatagttttcaaaccagccattttctttaactgtagattcacttactgctggagaaccaactcttaatccacttgaatggaaatcttgattatagctagaagctaagtcaacagacatatttgcttcttgatcataatcaggttcattgaaacttaatactttatcatatcctttttcttttaatgattttaaacgttcactaacatttcctgcatcattccatatcatcggtacaaattctagctcactatttacttcatcttgattatcataagcttcttcaccccagttataataccaagaaacccccatattttgtacatagcttaatgaattaataccttgatcatcctcatataaccctattcctttttttgaaatataaaatgtacgctcacttacatttatttcatcattattttctaaaacagcaacaactcttattgtatgtcttgctactgctgttgaataaatagttgtttgtgttatatttgcttctacacttttttcatatttcccatcaaaataaatatcataatgttgaactttttctaaagaattccatgaaatcttgatatctccagctgctacaagttgtcctttagatggagattttaaagctgttgttttccaagtatcataaggattatcttgtgcattgatagaagtcatataaggtataaggaggagggttgcacttaaaagtgcaacgcccaattttttaaatcttttcatttttaattttccttatttcttctacaaacagtaacatatccacctgctgcagccatcattaataatgcatatggtacaactttcatattatcacctgtttttactttagacttatttctatttattgtatttctttcttgagttgtttgccctttttgattatctccttgtccatttgtatttcctaatttatctcctttagtttcttcttcactaggagttgttgttttagtttttaaggcatcagtagcttcttttaaagcaccataagcttgattgacttcttcctgagtggcattttcattattaagaacttcttgagcttttgacaatgcatctttaaatactttccatgaatcagcggtatagctttcttctttaaaatcttttttatctgtataaagtttatctaattcatctttattaacttttatttctaattgagcttgtgcatcttttaattttttcaccgcttcatctacatctttttgtgtactatattttaatccatcggctgttaaaatttttgatgcatcagcataaatgtctgcatattttttataactatcttctgtatataaattttcattctttttattgttaacaagttcttttaattcatctaaatctaaatcatcatctcctaattgtttaatattttctattgtatccacaccaatatatttacctttttgatcactattattagctttaccaacaacagcagtaccatttctataatttaataagaattttctagaccatccttctcctgtaataccactgcttacacctgaaccaacaccattaataatagaattaaatttttgtaaagctccatcttcattagcaaatgtttgaatacaagcattttcaattaatacatctttattattaggaacttcaattgcattatccattgaaatagaaacagttttaccatcacctaaagttcctggttgcccattttctcctaaagttccacctgtataaataaatacattataaatacctaatccaactgcataatgtttttttacattattagctactttataagctgcataaccatttaccgaaccattatgagacatccaactttcttgagaaataggatcataacatttttcattttgatagaaatatgttgaaccattttcaccattccataatgtatcatatttgttgaaatgttcattaaataaagcgtaacatgttacatcatcaccattaacaattaatccatgatttgaaacatttccatcccaagcaacaccagttccatgatctgcacgccaaatccagaagtgatcacataaaacattatgactattaatctctaaagcattatctgctgttgtcaatgtatctgttgttccaccaactctaaagaataaatcttgtaaaattgttggatcatctttatgactatttttacttcctgttttccctacttttaataaatattttgaatgactacctgcatcaaaaataattccagcaactcttactccgtcaacatcatcaactaacatagctgcatcatcattatcaggaataattgaagtcattccactacctaagacaattgtatcagctttttttacatgaattgtttccttagcatgatatgttcctggagtaaagtaaatatttttacctttatctaaagctttgttaatatcgcttgcagaatctgttggtttagcaacataaaattcatctaaagaaatagattttccagctcccataccattattatctttaccttctccccaactaataccttttgtattcttttgaactgaaggaacaaatactttatattcaccatcatcatccatatataggaatggtttttctgctaattcttttgtttgatcaatatgcgtgaatacttgttgtcctccatcacttgctggaatattccagttagaagcaccttgtccacttaataattcttcaccacttgttccatctgcttttggtaaattacttgcttcaactccttggaagaaattatttaaagtcgttccatatgcatttccttttaattttgagtttcttgtataaaattgttgcccagagaaagtacctgcactcaattcatttccattatcattaaatgaagcattaatccatgaatctgcaacatatcctccacttgcccatccataattccaatcataagcaattggtctttcagaataaattcttctaagtggagcagcttgtgccactgcccagtttaattgatctgctcgatatgaaccatatcctgcttttccttgttcatttcctgtattataaactgctagattttcagcagatctccagaaattacaagttgcattgtcgccatttccacctaaagctcctgctggaagataagctggaatagcaatattatttaatttaacatctgttggtacttttcctaaaccacttaatgttgtatagaatcccaaatacatacatgatgtatttgtataatcaccttttttgaaataaacttgatattgatttcctttaaattgtgcatcatttgtataatcattttgttgtttaaataatttattcaataattcatcaatttttgttgtatcatcatttggtgagaaaacaaaagtatttctaccaaataattcagtttctaaagaaacatattcagattcatctgcttcttccgcattactaaaatctagatctccaaaattaccattatttaatgctacaaccttataatagttgttatatttatttttagaatctagtgcatttactttagcgctgtttgtattaacagtagcaacttcagtatattgaccaaacatacttgttgctcctaaaatacgataatgcgttgcatttttagctttatcaaaattaatagtaaattgattattagattgttgtaattttaaatttgttactgtttgtggtttttcaccaattcttgtagaagccttgatttttttagtttcataaaccggattatcagataattctaagttaccattaccactaataaattttaaatagaattcatattgagttccttcttttaaatcattaacagtataatgatcgacatttgtaatagttgtaactttattaaatacaacttcatttgaagcttttgcatatacttcaatatcagtatataaattcaatggtttatcccatgataaatctatacttgtttttgttcttgtactcttatcaaaagtaaagtgagaaacttcacttaattcttgacttgtatggataataaatctttcattatcaggaatttcatcagttgcttcacatcctgcttctaaaatattatcatcatttacttttacataagttccctttgctgcatctcttaaagcaaattgtccattaccaagtggttcaatagcaattgattcccaaccaccatttctgttaatagaaccaactaatggtgtagcaccgtcaatccatttagctgaagcaatttgatatcctggtttacttactgattgaaatgctacaacatctttaataccatcaccatttgtaccataacctacattaaacttttcattatctgtaatattttctttatcacccgtaacagaaattggtgcatattcttcatcactttgatttttaaatgttactaatttaccagtagcgacactttcaatatatgctgtattatcaataagttgtggattttcaacaaatgtaaattctgttgcttggcttgcatcatcacttaattttcgaatttcaccttgttcattgactgttagataatatcctcttgtcatatctctaatagttcctacaccatcatcggttttagtaataatataagaacataaatcatttctaagatttggatcagcaaaaataaaatcatttccttctgaacgcattggatataattttccatctactgtttgatattcaatatttacttttacttcacccttagaagaatccgctccactttgatcatctaatggcgttattttaaaaatagaatttggtaatacttttccagatttcgtataatcaccatctgcctttgtatcattatttccccagtttatgttatgtacataaattgctttattatttgtttttgaaatcactgcatacgtcttacttttattaaattcaataggcgattgcatagcttgaatagttgcaatacttgccatcgacaatgtcattgcaaaagtgagtaccatcgcaataagcttttttatataactcatattttaatcctcccttaatatttacattcatcttgtgatatttataaaagttggccaagtttttataagctatgcactgaacatgaatgcatatttatcacacaaaaataaaatagcatataagccaaaaataagacagcgctttcaaatttaatgtaacaggttacattctttgtaacaaaatgactttttgtcataaaataaaaaaagtgcctttatatgcacttttattctaatatttctaagttcttttgagtttgtaattttcgacaaatacgttcaataatataaacaacaggtacttgagatgaaatatttttagtatttggtaaaataacttttttaatgaaatacggtattgttaaatctgacattttagcaattgtgctatttgaatcatttgtgattgaaataattttagattgaacacctcgataaagtcttaattgatcaataacttcttttgtttctccactatttgaaaaagcaattaataaacatttttcaaattgatctgttggtgcaggataaaatggatcatcgatatattgactataataaccaacattagaaaaaaaacgtgctgcatatcttgccatacttccactttgtccaattcctaaacaaacaataaagttactatctgtaatatactcaacagcttgatttatatgctcattaaattcttttcccttagaataatcaaaaaactgattgagcatagtaatttcatcatcaatttcaggcatcttattaatttcattaaatctttttaattctattttaaattcaacaaagccatcacaatctaatttatgacaaaaacgcgtaattgttgctgttgatacatgactttgtgctgctaattccctaatattcatttttaagactagtccaacattttttacaatgtaattataaacaataagttcagtatcattgagttttgaaatttgttcatatgtaaaaatcattatatcaccttcccaaagtatatattatcataaatcttcattgataaaaatatcatagtttttaggcattaaaaatgattgaaatcaagtattagacaaatcaaatttgaattctataatatagataagaggtgataaatttgaaatatacaacattaggacaaacaaatataaaagtatctaaagtatgtttaggatgtatgagctttggaaaagcaggaacgatgcatgattggactttagatgaaaaacaaactgaagagatggtaaagcacgcccttgatttaggtattaatttttttgatactgctaatacgtattcaaatggtacaagtgaagaatagttaggaaaagctttaaagaatttaaatgttaaaagagaggatgtcgttattgcttcaaaggtttattttaatgaaggtagattatctaaagaagctatttttagagaaatagctggtactttaaagagactacaaactgattatttagatttatatattattcatcgttttgactatgatacaccaatggaagaaacgatggaagcattaaatgaacttgttaaatgtggaaaagtacgagcaattggtgtttctgcaatgtatggatatcaatttcataacatgcaaatcattgctagggacaatcattggactcctttttcaactatggaaaatcattacaacttactttatcgtgaagatgaaaaagaattaattcctatttgtcaacaaatgaatgtctccttaatgccttatagtcctttagcaggtggacatcttgctagaaacacttgggagtcaaataccttaagagggaaaactgatcgggttgttcatggtaaatatgaccattttgaaaagcaagatatggaaattgttaaatgtgttgatgaattagcacataaatatcattgcaagatgtctcaaattgctcttgcttggcaatgggctaaaggtgtttcttctcctattattggtgctactaaaatgcaatacattgatgatgcagtaatggcattagagatttctcttacaaatgaagatttaacttatcttgaagagatgtatgttcctcatcctattgtaggagctattaatgaaaacccaccacaaggaactgttttattagataaaaaataagaaggagttttacgactccttctttagttttgtaaataggattaataatattgttcctactagtgttgaacaaacaattaaacttaaataagaaattggattttgaaccatccatattaagaataatccaccatgaggtgaagcaatagaacaattaaagtacatagataatgctcctgcaagtcctgctgaaaggcaacaagctggtaaaattacttgagattctttttgaataaaaggtatagctccttctgaaataaatgaaataccgttgatataattcattaatgcatcatttctaacttcaaatctatctttaaataaggttgctgttaaagcaatgacaaatggtggaatcattcctccagccatcacagcagccattggataataatcataactcattaacatacctatagaaaatacataagctgttttattaataggtcctccattatcaatagccatcatcatacctaatacaaaaccaaataatacttttgttgacatttgtgattcaactaatgaaacataatttaaaatataagtatgaccaatatataaataactatttaaataaaacattaataaagtaacaataattgtagaaataattggatgaaacaaggatgcttctattccttttaaacattgtggtaaataagaaaataactttcttaacatcaaagatacaaatcctgctaaaaaacctgcaataattccagcaagtaaagaaggtgaacttgtagaaattgatgtgattgaaattccttgacaaacaatcaatcccccagcaaatccagaaagcatacctggtctatcagcaatactatctgcgatatatgctgaaataatgggaataatcataatactaatgagttgttgtacattacttgtaaggattaataattggtttgtaagtacttgatctttaaataaataaagaattccatagagtaccccacttgttacaagaaaaggtaatgcatgagaaataccattcattaaatgtttatagaataaacgaatgatattttgtttttctttcttttcttcatgatgatatatctcaccatctccattattagctttttcaacaagttcttgagctttagagataccatctctaacaggtacttgtatcacttttttaccttcaaatcttgccatttcaactttcttatcagcagcaacaataattgctttacaatgttcaatatcttcttgtgttaattgatttttaacaccttcttgtccattcgtttctactttaatagaaatatttaatgcttctcctgcttgttgtaaagctttagccgccataaaagtatgagcaattcctgtaggacacgcagttactgctaaaacagcaggatgaacaatttctttcacttcttcttttttattttccttagcatctattaattgtaaaaattcttctttagaagatgcattaattaaagcatttctaaaatcttcttccattaataaagtagataactgtgcaagagcttgtaaatgagcacctcccgaatctttaggagcaccaatcataaaaaataaataagtaggttgtccatcaagagatttaaaatctaatccttctttaacaaccattgcagataatcctgctgtttccacaccttcactttgtccatgaggaatagcaacaccatccccaattcctgttgtactttgggcctctctatttaaaacactttctttataaatttctttatcatttaattttccactttgatctaataaattaaccagatgatcaattgcttcttctttattagaaatttgtggatttaaatctatcgaatttatatctaacaattctgtaattttcatttctaacaacctttctttttttgtttatcataaagcaaaaaagttgttcaatcaagaacaacttaatcatactgacataacttataaatatctttgatgcaagttcctacatctgctggtttatgtgcatcactcgctgtaataatatccacatgatgttctttaaaaatatctaataattctttagaaagacctttatcttgatgatgataacgataataacatcctgtattacattctcctttaacatgatgttttactagtaacttggctaattcatgatatgttggttttaaatcatatgttggataatagttaaacattttaattgtatctggatgagctaattgcgtgaataaaccacttttaactaaatcaaaaatcaattcataatatcgatgataaatatcatctacattatatttatcccataagatttctttagaccaaggcatatcatataaaagtccatcaatagaatgaatagctcctactaaaaaatcaaattgataggattctaaaatacgtcttatttcttctttatattcaggaacataacatacttctaatccaaataaaacttctattggaagttcttcctcttttacctcattaattaaacgcacataactagaaagtgtatctttaaatttcattttcttattagcaagccattctctttgttgatcacttgcttctttaacaccttgataaataacttcaaattctttaaaacgatgtgtatgatctaaaatttgaatacgatcaaatccttgtttataagcttcattaataaattccattacatattctttagtaagtggtccgttttctaaatgcatatgtccatctactagcataggcaatcctccattcatgttgtatacaattatagactttttaataaaaaaaacaatcaatttgataaaacatcttgtgacaaaaaagtaacaaaaacagtagattatttcctctctatattttactaatatttgactattaaatttatcattagatttaaaatttaaattagtagcatataaatattttagcatacttagtatttgttaagaacggtcgttcagttttgaatagtgtcgttaggtatttaaaattgaaaacaacgaaaaagcctttaagcatcaacttaaagacttttggtatattaaattatccggtgcttagaggttcactctaaattattaggcggatgaacttttttcaattataccttccataaaatatacctcctactatatatatcgactatttttttgcttttttctttaaaaaaataaaaaattttaattcttttagtcacatagcttttgcttgacatggagaagtgaatgttatattcttatatcatactaattatatatgaaataaataaattggtacaaaataaaatgggggaattaaaaatggaaagaattacaagttttagtgttgatcatcgaaaactaactaaaggagtttatgtatcaagaattgatggggatttgattacatatgatattcgaatgacacaacctaatgttgagccagctttaaaaccagaagcagcacatacgattgaacatattggcgcaacattacttagaaatggtaaatataaagatcaagtgatttattttggaccaatgggctgtatgacaggcttttatttgattgtgagagatttagatttagaagtgattaaagaagttgtaaaagatgtttatagtcaaattgcctcttgggatcaagagattccaggggctaaggaagaagaatgtggaaattatacattcatggatttagctgaagctaaaaaagcagctaattattttgtaaatagtaaatgggaacatgaatatcatctattataaagggaaaacaacaatgaaaaaattagggattaaattattagcacttaccttactagcaagtgtgacaacaggatgtgcttcatctaaataagaaaatacatgggataaaattcaagaaaataaagaaatcgtgattggaacagaagggacatttgctccattttcatatcatgatgataacgataatttagtaggttatgatgtagaagtatcagaagcgcttgctaaagaattaggggttaaagttaaatgggatagtttaattgctggacttgattcagataaatatgatttagtaactaaccaagtggctattacagctgaaagaaaaaatatgatttttcaattccacatacatactcttatccagcaattatcactaaaaaagataatacagaaatccctaaaatgagtgatatcaaaggacataaattttcacaaacaggtcatggtttatccatgacttttatgcatctctaacatatactattttattcttttttaaatctttaatgattattttaatttctttattttttttagtgctatctgttatataagataaatattttccatctattgatatttttaatgaatatactttttcttttgttaataaagtactttctttataagtaaaatcatacataaataaaccatcattttgggtgtaatatagtttatctttatatatatcactattttcaatttgttcattaaatagaatttgattatcacaatataacttatcatcttgaatattgtgtaaatagagatgattattttttatatagaaataatcacataatggagtatctaatttttcttttttaaatgtatctagagatattttaatgattgtataatcatcttgtagaaaataaagatattgatgataaatagaataacggtttgttaattttcctttataaacaactttattattttgattagttattttgtcactataaataatataatatctattcttgttaccaataatacctaatatattcttatctgaaatagggatatgttgttgttctatattcataaaattcttctgtaaagaagataacttttttaatttaacatcttgaaaatcattattaaagagatataaatattcactttcatcatcgtcaatagtataaaaaaagccatctttttgaggaaatacattaattaaattattactagattcataaagatttcttattaaagaatactctttccaatcatttttatctattatcttattagaaaaataataatattctttattttccgcaaagttaagttcatgataactattgtattgaaaactagatgaattattttgattacttgaacaaccagttattaatattaataaagaaagaaaaatcaagttctttctttttcctttaaaaaaagaaagaagaaagaatataaagataataatcaattcaataattactatatgaaaatctatgcctaacattttttcaccataacctgcaaaatagcgaccaggaacaagaaaactaataaaaggaaaataaagaatatgtatactatttcctaagaaagctaaaggaatatagacgaaaataaaaagtacaagcaaaataaagatattagaatgaataaatttttttagtaaaatacttagactacataaaagataactcgctatatagtaaagaaatgtacaaaagcatataaatgttattaatgaaatatttggacaattttttgaacaccaaggaatattaattattgaaaaatctaatctagaaaaatgtttaaaaataagtattttaccaatagtcattaaaattaaaaataatccccatatacaactaaatacaaatattttactctttttagcattcttaataccattagatgttgttttttcataaatccatatatgatcatctatttcttttaaatagatactataaataagaaagaaaagaaagagaatgagaataaaatctagattgttaaaatttaaacaatcagtatactttgtattaactatttccttattttgagtatttttaattctatgtatctctatacctgatagtatagttacagatgataaaaaattcaatcaaggtactcaactagctgcattggcttatgaaaatgaaaaatcaattctgtatttaagaaccaaatatgaatacggtgatgttgatatggcatttgctatcgcgcatgaattaagacataaatatcaaatcgatacacatgtctttgattttgataattataaaactagcaatgagctttccataagagaatacaatcttcagaatgaagaaatagatgctaatgcctacgcatacatcgttttgctagatttttttaaattaaaagttgatttcaaattgctcttaaaagatgatgtcgttgctgatacaattatgaaacgtgtagatgttatcgttgaaaacgaatacgaatatgaataaataaaaaaacctactcttgattgagtaggcttttttttaatgtaaaatattcaattgtttcttgacgtcgaataatttaactaaagtatggatcagttataatacaattaaatttttacaactttaattatactacttaattatttactgtacactccccattgttcattcattttttcaatttgatattgatatttcaaattttcttgttttaatttctcaatttgattatctttttctatgatttgagaacgatattgagtatttttggcaagtaaacaaatattcaataaaagtaatataatgatgataatctttaatcttttcattctaaacacccattaatttcaaaatagtgtttcttcctgcaattccatcaactttcaatcctctatctgattggaattgttttactgcagcttctaatccactaccaaatttacctggacattcaacaccagatggatcatatcctctacacattaacgcaatttctactgctgtaaccatgtattgagtttctttacgtttgacatagtgtttacctaaagccgatttactgtttttaccaaaagcaccatcaacttttaagtttttgccatagtccaaattaatagcgtgttggaagcatctagcaatatttgctcttgattgaattttttatcatctgtaactatactatcaggtatagagatacatagatcctcacatacttctttgataaattctaatattccattcatattttttctcctatttgcaaagataatccatattcaacaaacgattatattttttcacaattctttgtgcatcgtctatttctttgatgtttaaaataaattcttttgatataaaagcattgttttttatagaagaaccacctaagcgttttttgaaatcgccatcttgtactttgatatcaatataagaattgattttatttttttctactcttacaaaataatagtttctgcttattttaacttttaaatcagttgttccacagcttaaactatcaatatttatatacatgtcatggtttaaatttatttctttcatttttttcaccctctcaattaatcatcgattaattccattttataagtattatcatataatttattaaatctttcataaagctctgtttcaatgtcttgtgttaagttttcagcaataatagcaacaccattattgtctttatctaaaaaatcaattacagtaaatgtcccatctttataagggtattcttgaatctttctagaatattctttaattccattatcaattaaaaattgtctgatttcttgacttgtagcattcatattttcttctcctttgcaaacattgatcattgtattttttaataatcttaatttttcttctgatagagcatttccattatttttccaacctctaaaggttgaatagttaacaccagctttttcacaaattactttcatattaaaatattgtgatttttctaaaatgaattgttttaaatcttccatttctatctttcctttctattttttatacatataaataaaattaccaataccgctattaatccgccttgcataatattttgatgtggaatataatataaacggaagagggattttttaattccctttcctgtcttttaagatttctttgattcctagaacgatcgctacaacgtatgctagggtttccaagaaatcttttaaattataaattccaaacatctctatcctcctttctacacttatattataatacaaatttgtattatacgcaatacttatttgatataaataatacaaatttgttgtaaacaaatagtaaatattttttaactatttgccttgttatataaattggtatgctatttattaatggtggtcaaattggtagtcaaaagccagttattttctaaaaagcaacgctataatgcgggttttgaacgttcatgattcttgactcctaagcgtagagcagtatctagcctaaatgagctataacgggcagaaaaaagcttgattgaattttttatcatctgtaactatactatcaggtatagagatacataggtcctcacatacttctttgataaattctaatattccgttcattatttttcctccttcaaattataaattttattatataattcctctatagttagatttaaagcttcagaaattttcattccattttccactgatgtgcttttaaattctgtattgcttttaataatatccaccagagttgagcgagaaattcctgtttctctaacaagttgagcaattgttttatcagttaaatccaatagtttcattattatcatcctttctaattgatttcaatttttgcgtaactatcatcatatgatacgtcaccccattcttcatcccagtaagaaccagtgtcgtgatcgctgaatctgatacataattcttttaaatcttctagctcttcatcatccatatcgtcatagtaatcggcatcgtcagtttcattcataaccatttccatgttcctttgagtgtatggaatatatagatatgtgctgattgattttctagaagtttcaattctataattttcaagattgaaatctttaactaacatatttattttcttttcaatatgtcttaattttgattgagcatcagcaagttgatcatcatattttctatagtcatttattgctttatcagtatcatcaggaagacattcttcataataaaacaaaaaattaattgcatcttcaacttcatcttcatcaaatctataatctcgaccgtattcttcgcaatctccatttttttcaaaatcgatatcttcatcttctgccgcttcatctttcatttcgaagtagttttcaatatcccaatttgcagtagaaataatattttcaactgcattttttttaaaaaaaagtaaatcttcaatataattatgttccatttttcttcacctcttttttttaatcttctacagcactttctaataaatattgagcaatttcatattgattgttgaaaattgcttgaacagcagttactattttatcaacgtaagtaccagcttgattgtagaaactttttttataataaacatcagctagatcgtaaacagcagagataacttctttgctgacatgaattttaccttgtttgttacaagcaaagacaacgtttgcttgttttcttgtgattccaattgatacgtttcttccttcttttaaacatttatgtaccatttcatttgcgaagtcatgtgctctttgttctagtgtgttcattttcttttacctatgtcctttggactacccttcttattacacttatattatataacggtataccgttaaagtcaatataaaaatagcggtttatcgttatttttatattatagacatcataaatacgcaaattcacatgcacattcaattagttaacagaaaaagcaaatgtaatattatctattcttcaaaaaaaatctacaactttattttattaaccaaacaaaaagacctactcattgatttgagtaggttctttttttatatattatttgctttttcaatcgtgtcttgcattgcttttctgatcacatctgattgtttaattccaagctttttacaagcttctttgaattcatctacaaattcagttttgtacgatgcttttacttgcttcatgttttctttttgccattctctcatgtattttgcttgatcaaattttttatttttcataattattcctttcctaataaataaaagcctaaaatcattaatatcattcctaaaaaccaataagttttaaacagtgtaaggataatacctaaaaacagaattattatttttatttcttttttcatattatttgatataatttagatgaagaaagagagaagaagattatttcttctttctcttctttgaactctttttgctgacatattttgaaccgatgtaaccaacaattagagttgctatgggttgggcgaagttattaaagatttcgctcaatttttttaaatcatctaaattcatatccttacctcctctctttacaagattatcataacataatagtaccattatgtaaagggtaggaggcatttttatgcattttttaatttctctatccttattgtgtatagggataataattacaaaaaagcgatcaaatttatttttggcatatttttgacacatttctaacttgctatctactggatagctactgtatgtctactggcgttttggatttttttattaaaaattgactaaaactgtgactgatactctactggatagctactgtatagctatcgacatttcaaaagaaaaggcatggaaagtcttacttggacacaataaagattttcatttattttttttggatgaatatttttaccaaatttatcaatcatattggaatagacatttggtgtaaattcaagttcaataacttcgattttcccttcaccatacatataagtcatattattgagcttcttttcaaatgagtttaattgataatcatcaaactttacatcactatctttaacgatctcaacattttttacatagtctaaacgatattgaatgcatgtatttggatcttttgcaccttgacataaaagataatattcattgttagaaaagacagtatcgataggagctaattcggttaatttatgtttttcattaaatgttaaagaaggtttttgatattcaaagcgaatttttttcttttctttgatagctttggtaatgacttctaattcttggtagaaaacttgttcattttcatttttaacaacatgcagatttagtcttttttgaaaataagcttggttatgaatactaaatagatcttgcattctttttttatagttttcttttgtttttaaagtaaagaaatgagaactataaacaagatcaataatcgctttggcttccattaagtctagatttggattttcataataaaagtaattatttcttccttctttataagttttaatgattgtatcttcataataattattatagttttctacaaattttttaacgattctaaagtctattttaaaatcatagcctttatcataaatcaaatcttgaatttgattaatcgtgattggatttttttcatcactatttttaataattaaatcaatcacagatatatatttaatatatgaatcatgatctttatttctattcatttaaatcacctcgtatcaatatcataaacgaaaacattcgttaatacctgcttatataagacggtattagcttttttatcattatataatagattcaaagaaaagggggatttgcatgttaaaaagaatcataaataaaattaaatatcatttgattaaagaaattgttttagtagatagtgaaaatattggttatcaaataccagaagaaataccaaagcatacattagtttatctttttatcagtgatccatttattgatgagaagataaaagactataaaaataataaacatataaaacttatcaatatttcaaatatcagaaaagaatgtataacgaaaaatattatggatttttgtattgttgcagaacttacaaatttactttcttatgtttcaaagaaaacaagaattgtcatttgttcaaaagacagaggttatgatgcaagtatcttatatttaaaagaaaaatatccaaaacaattagtttcaagacatccaggatcattttgttattactataacgaaggaaatgaggattacctttctattatgtcaaagataaatgattctttaagaaagaaagtattaagttattcatgtatggattctttgaaaaatgctttaagtaaaaatgaaaagaaattatttgttgtagaagaatatattaatacaattggtatggttaaaacatttattgaatttgatatttatcaaatgagttatgaactttattattctggaacacatgttagatcttttgaaaataaagaggatgttttctatgaatatcaccaatgtattgcaaaaattcatcatatttatgataaatatgaatctcatgaaagatttctaaaatcaagacatcttcatattagacattatattgaagaagcatcaatacaaaatctaccattagaagaatgtttaattaatcatttaggaaaggaacaaggacattctgtttataaagaatatgttagttaggaaaaaatattatggaaagaacaataagagtaacaggtaaaggaaaacttgcagtcaaaccagatttaatagagttaactttatcaataaaagatataaaaaaagaatacgatgagctactaaaaagatcgtcaagtgcgacaaatgaagtaaaagaattacttgaaaaaattggctttgaacgaaaaaatatcaaaacaaaaagttttgatatcaatatagaatatgatagttatagagataaaaatgataaatgggttgaagaatttaaaggctatagctttattcataaaatgaaaatagaatttgaagcaaataataaaatgctaggccgtgttttatatacattatctaaaagtacgtcttatccatcattttctatatcatatacagtatcaaatccagaaaaatataaaaataaattattagaaaacgccattaataattctaaggaaaaagcaattgttctagcaaatgcttcaggtgttaaattaggaaatattctatcaatagattattcgtggagtgaacttagaatatcgtcatcaccatttgaaaacaagaaatggttctttgaagaagataatgatgaatctgattatgtaatagatgtagaaatagatgatatagatgttacagacacagtaacagttatttggaatatagaataaagaggtgatagactatgtggacaatatttaaattgtttttttacatcattattttgccattaagagcaatttggtgtttgttgatgtcactgtgtggaatgtataagaaataaaatgtaaagatttaatctagcaatatgagacaattacttaataaagaaaatgcatttaaaaatttcttttaataaggtatgatgtatttaataatagttaaagcggtaataaagatgaatacaaaaaaatacatgatcattataaaaggtgaaataaaaacaagagatgtcaaatttttggaacaagatgatgcaagtcacaaaatgaatgttacgtttaataatagaaaaacatattcttatactttggataatgttgaatttctagagaatcctaaatttcttgatccaagaaaataccatttaagtaaggatggaaaaaatttttttagtgtagaagcaatttatgaatttgtaggaaaaaatgcaacttatattcatgtttgtttcaaaaataatgtggaaagagattattataaaagtcaattagatattcaagaatcctacttaaataaaaaagatgcagcaaatgtatttgattatattaaagaaatatcaaaattaagtaatttaaaaaatgaaagtaatggggagcaattgttacctaaaaagtttaaaaaaatttcatttcttagaagtgatgttgcacttaccaaatatcttaatccaaaatcattaaaaaaaagtattgatggagaatacatgcctattttcccatttggctgtaataatagtcaatatgttgcagttaagcgagctatggaaaatcaaataagcgtgatacaaggtccacctggcactggaaaaacgcaaacaattttaaatattattgctaatatattaattcaaggaaaaactgttcaagttgtttctaacaataattccgcaactgaaaatgtttttgaaaaactctcatcgtcaaaatataatttgggatttattgtcgcaacgttagggaaaagtgataataaaacaaattttattaataatcaaaaaacaaattacccagattttacgtcattgaaaagtgatgacattcaagatgattttatgcaacaggttcaagaaaaatcaaagaaattaaaaacagtatttgataaacaagaaagattggcacaattaaatcaagaactgaatcgtcttaaaatagaacgaaagtattttaatgaatatttaaatgaaacaaatgtaactgtggattatacaaaatataaaagaagtatgaagtcgaataaatggatgaagttatggcaagaatgccaaagtatttcagaagtaaataaggatattgatttctttttaaaacttaaattcttttttaaatatggtttatacaattttagtatttattcattagaaatatctcaaattataacaactttccaagctttttattatgaaacaagagaaaatgaaatcttaaaagaattggatgacattacagcatatttaaataatacaagtaatcatttattagataatttaacaaatgattcgatgaaattcttaaaaaattatctggcaaacaagtacgaaaaaaatacttacaggcagttatttacatcagaagatttcttgaaaaatccttatgatatattaaatgaatatccggtaatattaagtacaacattttcctcaagagatagtttgaatgataatgtcgtttatgattatgtaattatggatgaatcttcacaagttgatattgctactggagcacttgctatgtcctgtgctaaaaatatggtcattgttggggatacaaatcaattaccaaatgttgtagataaacatactgaaatacgagcagatgtgatatttaatcaatacaatttaagcaaaggatatcgatttacaaacagttttttacaatctgttttagaagttatgccaaatgtgacacaaacgatgttaagagaacactatcgttgccatcctaaaataattgagttctgtaatcaaaagttttatcgaggcaatttgattattatgacagaagatcatggcgaaaaagatgttttaaaagtaattaaaacagtaaaaggaaatcattctcgaaatcattttagtcaaagacaaattgatattataaaaaatgaaatcataccaaatgatattacaaataagaaagaaacgggtatcatttcaccttataataaccaagttcagtctttgaaagaacaaatagatggcattgaacaagcaacagtacataaatttcaaggaaaagaaaaggatactattattatttctactgtcgaagatgaaataactgattttgttgatgatccgtatttgctcaatgttgctgtttcaagagcaaagaaaaaattgatattggttgttactggaaatgaacaaaataaagaaagaaatataatggatttaatagattacattcaatataataattttgaagttgtagagagtaatgtttattctatttttgattatttatataaacaatacacaaaagaaagaaagttatttttgaacaaaaataatagaaaattagaatatgattcagaaaacctaatgtatactttgttagaagaaatattaaaaaatgatgattataaaatgttagattttgtgtgccattttcctgtcaatatgcttataaaaaatccttatttattaaatgatgatgagtgcttatatgctatgaatccagcaacgcatgttgattttcttgtttataataggataagcaaaagagcaattctcgccattgaagtagatggctatgcttttcatcagaaggaaacagcacaagcaaagagagatttgctaaaaaatcatatttttgaactttattatattcctttattaagattttctacaacaggtagtggggaaagagaaaaaattattaatatgctaaataaaatcttaaatataggtgatttaaaataacaaggtgtactttttattttaaaaaaagtgatattcaaaaaagaagacaaattgatgttactagattttcatagctaaataaaacttatcaacataatcattttctatagctaaaagtaattcatctttatacttgctatcattaattaatttaactagtcgagcattcctttcttttaaactctctattacatcttgagaaggaatgatatttgattttgatgaattatttgatttgcttgttaaaactaagttccaaatatcatcactgtacatgaaagaccacggaatgacatgatcaacagaaatatcattttcttgtaatacttttccagtataaaaatcaattgcctgatagttattgctttttaaaagaatatttttatattttgttaaactgcttcttttaatagtattatcagaaatgtcttttactttagaagcaattcttggagaatgattaaatttttcaagaagttgagcccatttaaaattaataagttgagataaaacaaaactatactctttaagcgatagtgcttgttgtttagtaaaagaaataaacatgcaatttttatctaaatagtaaagatcatattcttttttatttgctaatttaaatctccaggaaacatcattttttaatgttttagcactgtcgttgataattttacaatattgtttttcatgttttaaaatagtctcagctttatcaaaccaaacaggaacatgagtacgttgaatagattcatatagatcaattagaaaattgacattttgaactaaaacgggaattttctttttgtttggactttgatcaagatgaaagaaataggtttgattccaataatatttaatcatcttttttgcaatatgctgaaatgtaaaagttacttgttcatctaattgatttgtttcaaaacatagttcaataatagctcttccccatgcaagtttatatgtattatcattattcatattttctataatttctaaccactgtttgatatagctgttcattttatttctccaaatatttaatattatttctttataaattttaacataaagaaaatagatttaaaaattaatttctctatattttgtttaatagtacttttgcataatgctatgattaagagagaaaaagcaaacacttaggaggaaaaagtgttacagataagttgattgcttatcatgtagaacgtgctaagggtggcaatggtttaaatgctgttgaggttgctgctgttgataaaacaagtgtacttttggatttttatttatagctaaaaataagtatactaatggcttaaaaaaatcaaatgatgtagtacatgatgttagtgataaaacatgtattcaactttggcaaggaggtttagctgttgttttagattaaaaagcaaaaattctagttctaaatgatataccattaaatgcagaatatactgtgcaagaaattacttttgaaagattattagatatcattaataagtttggtgaggtagctaaatgttcagttgaagctggatatggttgtttagaatttcattgcgctcataattatttaccacactcaatgctttctagtgaaatcaatcatcgaggtgattgacttttgtaaagatgccaaagaatatggtgtcgatgttctaaatatatcacgtggaaatattataacagctgaaactctttatgaagtggctcctgtagatattgaaaatggattcaatgttgaggatgcgcacgtattcgtaaagaaacagaaatgcttacaatgccttgtggacgtatcaatactcctgaatttgctgaaaagatattagaagatgataaagcagatttaattgtaatggtgcgtgcgcaacttgccgatgcaaatttttgtaataaagctaaaaatggtcaagtgaatcaaattcgttattgtagtaattctttgtatgatccaagtatcaaacatattacgtgaataagaaatccaggattattagaagaagcaacagatagtctctctatgacttcacatcctaaaaaagttgttattgcaagtgaaaaagaatatttataagatggtgttattatggtagttgttttaaatcaaatgacacaagtgattatgaaaaacttgacatatcaactcatattattggtgattgtaaaaaagtaaatgttgctttgatgcgtttagagatgcatattatgcagtattagatattaataaataataaaacaggatgaacaacaattgtgttgtaatattcctgtttttaaattatttttagaattagtatagaacaattattaaatatgataaaattagataaaagaaaattgattataatagcttaaaaccaaaggagatatgtctatgtattttaaagaaccgtttgacaaagaaaaaattgaaaaacaacatgaagaattattaaatatttttaaagaagatctttcaaatctatctgataaaacaattaagaaacatatacaaaatgttgatttctttatcaatgaatatttattaaatcgtaataatgcaaattatgaagaagttaataatgaagttgatttgttctttagagatttctttattagaaaatgtatgtggtcttcaccaaattctataaaagaaacagcagctagttttaaaaagttttataaatcaatgatgaatcatgataaatttaaaaaagatgactatgaatgtttacgcgataccattaaagatgaaatgaaatcttggcaagaatcatgtgattactatgatagtggaaaaccaaattgggatccgtttaaattttaaaggtagggtaataaaaattgtataatgataagattgaaatagaaagcccttatggacatattaccattagctatggtcgacatgataagcatcgagtaagagttcttgatatagatggtggtatggaatcagcaacttatatagaagaagaattacaaaatgaattactttttgaatatatgtatttatttgatttaatgtttgatgaaaattatttagaagatagacaaattaatgatgttttattaattggtggtggtgcttttcattatcccaaatattttttagcacatcatcaaggaaatattgatgttgttgaaattaacaaagttctttatgatatttctaataaatacttctatttagaagaaactattaataaatttgataagaataaaaatagatttcattgttattttgaaaatggaagagattatataaataggaacaaaaagaaatatgatgctattttaagtgatgtctttattggtgaaaatttagtattagaacttcattcattggaagcaatcaaaagaataaaagaatctttaaacccacaaggaatttatataacaaatatcattggttcattaagtggtaaatatagtcaaaatataaagaatgttgtaaaaacacttaaacaatgttttaaatatatttatgtctttaaagcacaagaaaagaatgagcatcaaaaaagacaaaacttaatcgttgttgcagtagatcaagaagttcattttaatattgtaagttatcataatattaatcaaaagagatatcatcaaggaatgatcgatcatgttgatgatattgattatacaaatggacgtattttaagagataaaaatttattataattattgttttatcttaaaaaatatgataagtttaatccatgggaatgaggttctccctcgatttatatcgaaaccgctatttggctaatgacttctgtgtaatacacagggtgattagctttttttgtaggaggaaacatggaaaataaaaaagaattattaaagtatatgatatttgcaggtgttatgggaatcgttgtaggaggtattgatactgtttttggtaaaggacttattttaataggtgagatacgaaataaatatttttggtatttaattccttttttaccaattgcaggaatagtgattacttggctttactatcactttaatgaactgagtttaaaaggaatgacacttgtctttgaaacaggtcaacaaaaaagaaaagggattcctttagcacttattcctttagttatgattggaacatggttaactcatttatttggaggaagtgcaggtagagaaggggtggctgtacaaattggagcgacgatctctcattattttacaaaatattttcattttcctaagaatggaaaagttttgttgattaccggaatggcagctggatttgctggattatttcaaacaccacttactgctttgttttttgctatggaagttatggttataggtaaaatagagtatgaagctttacttccaggggttatagcatcttttactgcttcttatacgtcgcattttttaggattggaaaagtttagtgtaaatattcaacaaagtattaatatgaatgatttaaaaaatatgatgttaatgattttagtaggaattattttgggaattgttggaagaatattttcaacgtcgttgattgctttaaaaacattttttaaaaataaaatagaaaatccctataaaagaataggttatatttctattttattagtgatagggctaatgatttttaaaggaagatacagtggcttaggcacaaatttaattgatttatcattttatggaaatgtgacttattatgattggtttttaaaacttatttttactgttgtaactcttgcaattggatttcaaggtggagaagtaacacccttattttcaataggagcaactctaggatttatacttgccccaatttttcatttgcctattgaattatgtgtagctttaggatatacgggagtttttgcttcagcaacaaatacacttttagcaccaatgatgataggtttagaagtctttggtgggcatcaaatgatagcatttcttattatatgtatttttgcttatttagttaatggaaataaatctatatatactgcccaaatcaaaaatttctaacaaacattacatgatgaaaggctttacattttgctatttcaaagataaaatagtaatggtgatggaaaatgaaatttgatgaattatttacaaaattaaaggtgaatccattaaaactcattgagtcaattgttcatgctgatggatcatcagttattttgtttaaaaatagaaaaagtgaaatcttatatgttaatgatcagttttatcaaaaacatccacaatttaaaaataataaggaagcagttattggcaaaactgattttgatttgtttccggattcacaagaacacgctaaacaagcttttgaagatgaacaacgtgtcatggaaacaggagaagcaattaatgttgtagaaactgaaggaaaaaatcatgatggctatacgcttattgcacatacaagaaaatatccgttatatgatagtcaaggagaaacaatcggtgtttttgttattacagaagatatgacaagtgatgtaaaggcacttagagaaaatcaagaaaaagccaaaattttaacaaagcttaatgttgaactttcacaagaaaacgctatagatgctttaacacaactttataatcgacgttttattcatgcagaattagatacgttgcataaagaatatttagaaaataatacaccattttctattttgttattagatttagataactttaaaagtgttaatgataattatggacatcatattggagatgaagttattaaacatgttggaactgttttaaataatattaaacatcaaaaatatccaactatggagccatgtcgttatggcggagacgaatttttagttattctaccagcttatcaaaaagatggagcagtttcaattgccagagatattaaagatgcctttgatcatgttattttacatgctggtgcttatcatgatatcgtaagattaagtattggcgttgctggtattcgtgatgaagaaacaatacaagatttattaaataaatgtgatcaaagaatgtatatttcaaaaagagatggaaaacatcgtattacttattgatgatagtgtaaaaagctatcatcattttttattttgagatataataaaatcaacaaggaagtgataaaaatgtatgaggcaatcaaacaacttgcacaaaaataccatcaagaaacaattaatcagcgccgagattttcaccactttgctgaaagaggctggttagaaatacgtacagcatgtcaaattgcaactactttagaaaacttaggttatgaggttttagtaggaaaagaaattatggataaagatgcgcgtatgggattaccgccagaagcaatttttaatattaattatttacgtgctaaaaaagaaggggcaaatcctaaatatttagaacaagttaaaaatggaatgacatctgttgcaggtatcttaaaaaacggtgtagggcctgttgtagctattcgttttgatattgatgctttagggcttgttgaagattcaacagatgggcattatccaaaacaagaaggtttttcttcttgtcatttaggagcgatgcatgcttgtggacatgatggtcatgcatctattggtttaacaactgctaaaatattgatggagcttaaagaacacttacatgggactttgaaaattatttttcaaccggctgaagaaggtgtaagaggagcaaaatccatttgtgaaagtggttttttggatgatgtcgattatatttttgcagcgcatattatgcctcgtgttaaagattacgatctttattttggaatgaatgaatcatttgctacaacgaaattagatgtcatttatcatggagtttcaacacatgcggcagaatctccacaattcggtaagaatgcattgctttcagcagctaactgtattattaatttgcattcgattcctcgaaacagtgatggacaaacacgtgtcaatgtaggaacggttcatgcaggaacaggtagaaatgttgttcctgatacagcaaaacttgaaatagaagtacgtggtgtaacgacagaattaaatcgttatatggaaatttatgcaagagatattattaacgcctgtgctttgatgcatgatactgttgttgaaattaaacaaatggggaaagcatttgctttaaattgtgatgaagattttatgaatcaaatacgaaatatttgtgttaaagaaatgcccgatttaaaattacctccagaaaatttaaatccattaggaggtagtgatgatttttcttatatgatggaatatgtccaagttcatgggggtaaagctacttatatgaaattattgacagatattacagcttcacctcataatacatcatttgattttgatgaagaagtacttgataagggacctagaattatggcctctattgcttatacattattaaaataaaggagttaacgaatgatagaatttaaatatgatacacaattattaattgaaggaaaaaacttaaatgaaaatgaaattagtgagtattttacgaaacattttaaaggagattgtttgcttgctgtaggagatgatgaattaattaaaattcattttcatacaaatgaaccatggaaggttttagaatattgttcaacacttggtgaaatctatgatattgttattgaagatatggattgacaatcaagaggattaaaaggataaagatgcgaaagcatcttttttaataacttaaaaaatgttataattgcgaagctatttataaataaaaaagagtttttaatgattggaggtaaccatggttaatatatttgatacattaccaagaaacttttttaatatatttaatacagctgatcgtgttgttatcagtgaatgtatttgtgttctttatgagtatattaaggatgatgcatcctttgcatctttaaaagaaaacttgatttatgagttaacaaaatattttagtagtcacttaattgaacttgaagaacttcaaagtcaatcgccaagagagcgcgcactttatgtttatcgaagattaaaagaatgtggatggttgagtgaagaagttggtgaaaattaccatgtttatgctagttttgaagattatgctattagtattattgaaactttaatgaatttagaagaagacagagacatagaatactcaagtatggtttatagtatttattcgcagtttaaaaattttgatattgaaaatggacataagattcttgatgcacaatatagtatgacaaaaagcttaatgacaaaattaaaaaatttgaatacaaatattaagcgttatatcaaacgtcttgttcaagataatatgaaaaatgatttaaatcaaattttagattctttattaagtgattatcaattaaagatagtagatcgtgctttttataatctaacaactaaagatcatcctttaaaatatcgtaatagtatcatttctcaaattcaaaaaatccaagatgatcaagcaacatctgaaacgattataggaaatatcatgctttctaaagatttaacttatcaagaggcaatggatttgttttataaacaaacatcttatattattgatgcctttgaaagtattttagatttaattaatgaaattaatcgtaaaaatgaaaagtttgttgcttcagcaacaaatcgtattatgtttttaatgaatgtaaaagaagatattggtggaaaaatcaatgacatcattaaagaagggcaagaatgtccagaagtgtttgatcaagtagcaacgatttcaattaataaatacttagatcaaaattctttatatttaccacgacaaataaaaaaagttaaaaatacggatttgattttagatacacaattagatgaacaaacacgtttaatggcgattgaaaaactaaaacaaaatgaaaaatatacaaaaacagccattgaaaaaaatgttttacaatgtttggatcaacaagaaacaatattgggttcaagctattatgatcaaaataaagatttatctttatttattttgacatggctttatggttatagtcaaaatgctcgatataaaatagaaccacaagaaaatattataaagaaagatcattatcaatttagagaatttataataaggagagttgaagatgaataaaaatgaactgatgaaaaatatgtcacaggcatatttgttattatctgaaaaaagaaaagaagaattttcacgtattttaaatcggttattagcggttaattttatttgtggtggaagaaaaagagatcgcgaagattattattttattagtgaaaatgaacaactatttaaagattttttaatgatgcttgattatgattttcatttatataaagcagaccgtgtaatctatatccataatttaaataattacaatcatttaaatcttaatcaaatgcaaacaattgttttattgttacttagaaaactttattttcaaaaatcacaagagttacaagatactgaatttattcatatttcccttggggaacttcatagtgaaatagaagcaactggtatttataacgaacgtctaaaaaagacagatttaaaaaatatctatcatttcttgtcaaggtataatatatgtgaacgtattggtgatttaaacgaagatgatacacgtttaattatttatccaacaattaattatattttaccaattcaaaaaatagatgaaatcaatcaacgtattcaacaatataaaaaaggagatcatgatgaaaacattaacgaaagtgaaactgattaattggcatactttttctaatgaagaatttgaaatctataaaaatgccttaattactggagaaaatggaacagggaaatctacaattttagatgcgattcaatatgttttaactgctggtaaatgtaaatttaataaagcagcaagtgatattggaaatcgtacattagagtcttatattcgttgtaaaacaggaattgaagggcatgaatatgctagaaatggtgatgtgacaacctatattgcattagagttttatgatgaaaaaacagaaaaatatcaaattattggaactgttattgatttaccagctggcggaagattaaatagagatttttttcaaattattgattgtaaaatcagcgatgtagcatttattgaagaaagaagagttttgacgagaaaagaatttaaaaaagctttaattgatcatcaacaaacaggtatttttaaagatacaattaaagaaggagaaagtttatttggaaatgctttaggtgttaaaagtaaatattttgatttagtaacgagagcacttgcttttaaagcgattgataatgtttatcaattcattgttgactttttattaaaagaagactttgttgatattcaaaatttaagagacagtatcaaacactataaagttcttgaagaaaaattaaaaatatctaaaaaagaatgtgaatcattagaaggtgttgtaagtcaatatgacacttatatagatacgcactttcaaatggatgttttagaatgtttaaaagaaaaattacaagaaaagcaattacaagctattattgataatagtcaaaagaaatatcaaaaaataaatgatcagctaaattttgtacaacaaaaacttacacaattaaatcaagatgaagaaacttatcaagaaagatatcatcgtttagatgaatcattaagagaaaacgaaacctataacttaaaaaatgaattacaaaaagaaagtgaacaactcaaaaaagaaaaagaaaaaaaagaaaacagttatcaaactcttataacagaaattaaacaagaaatacaattattaaagaaagtaaaaataccaaatagttatatccaaattcttcaaaatcaagattatcaaacagaaacattgacacatgcatttagaaatattgtagaagaagtttctaaaagaacaaaggatgttactgaaaaaatatcacatttaaaaattgaaatgacacaaacagttgatcgttttaatgaatattgtaaagaatatgattctcttaaagaaaatcaactttattatagaaaagaaattcaagaattaattcaattattaaatgaaaaacttacaagtcattatggaaaaaccattgaagttaaaccattatgtgaatatattgaagttaaagatgaaaaatggcgaaatgcattagaaggatatcttaatagtcaaagatttgatttaattattgaaccagaatattttgaatatgcattgcttgtttatgaagaatataaaaataaaagaggtatatatggtgtaggaattgttgatgttgcgaaaatgtcaagatatgaagatgtggatgttaaaaacacacttgcaagtcaattagattgtaaaaatacatatgctagatggtatgtcaacatgttgctttctaaagtacaatgtgtcgatgatgttacacaacttagaaattatgctacagcgattacgccaacatgtatgctttataaaaattatacagcacgtgcaatcaatccacgtatttacaataaaccatacattggattaggtgctattaaaattcaattagcgacaattgaacaagaattggaaaacctaaaacaagaaatcaaattacaaaaagcaaattatgaagatttaaaaaatggtcaagcattattaaatcaatccaaagcagatcatatcttctatcgcttagatttcattgatgaatatcataatttactaaaagaatatcaagaaattaatgatcgctatgaaaaattaattttagatgattcacttatttctttacaagaagaatgtgatgtggtaaaaaaacaacttgaaaaaacaaaaagagaaaaagaagactcacttatgaaaaaaggaagtcttgaaaataatctagaaacatttaaagaacaacttgaacaaactcaagaagaatatcaattattacatgaaaaaatagttcaatttgaaatggagcatgttgatgttactcaagtagctgatcaacaagtcgttatttatttaaaacgtttttctaaagattttaatggtatgaaaaatgatattgaacaacaaggaaatggttatcaacgaaaggcaaaccaaattgaaaatcaaatagtcatgaaaatgaaagactataatgatgcatataatattggttttgaaaatgctttaatagatattgaaagttataaacaaagataccatcaattaaaggagatggatattgtttctaaagaagaaaaaacaagacaagcaaaactaaaatgtgaagaatcatttaaaacatcttttatttctggattaaatgaaaaaattgaaaatgctaaaaaagatattgctgaattaaataaaggattagcacaaagagattttaatggtgaaacctatgaattttgtgtttcaccaacttcaagagatgattttaaagaatactataagatcatccaatcaggaaaagaatatatggtgaataatcttttatctgaaacattaagtgaaagtcaaagaagaattatggatgatttatttattaaattatcttctgtagaaaatgatcaagaaacggaacaaatgttgatggaatatacagattatcgtaattatttagattatgatataaaaattaaatatgcaagtggagattatgcatatttttctaaagtcaataaagaaaaatctggtggagaaacacaaacaccattctatgtcattatggcagcaagttttgaacaagttattcgtaatagaaatcaaaatgaggattttggttgtgttgttatttttgacgaagcatttaataatatggatgaacaaagaatacaagaaatgattaagttctataatgaacgtgaaatacaaacatttattgctgtaccaccatcaagagcaagtacaattattccttatgttaatacaagattgcttgtcattaaacagggacaacaatcttttgtagaaggttttaaagatgaacaattatagaaatgaaatcttaaatgagtttattgatcgttatgaaaaaagtagttattataaaggaaaaagtgaaaaaccaagaaagatttctattgctttgcataaaaagtttcctgaatatggacatagctttcattatgaagaaacaaatgaattagaaaatattgtttttcaattacaatctcaaggatttgttgaattttctaaaaagagcattttaggagatagagaactcattttaaatcaagaagaaaattgtcttgatcgaatttataaagaattaaaaagagtaccagttaaagagaaaataatgaattatctacatcagcttgatgaatatcatgtagaaggatttgtgaaagactttattgatgaaatgaaaaagaaaatcatgtatgatcaaagtctttctccttatttaaaaagttatgatttagaagatttagattctgttataaaaatacttaatggaatgtattatcaagatgaagaaatttcatttagaaaattttctgagaaaatattaaatgatactaagaaattaataaagtataaaaaaagaatattacatattgtacatgatttttatgatgattctttagaaaatgaagatgaggtctttgaaactttttacatcagaaagaatccagcttatgtttacattagaggcaatgctatttttaaaattaataatcaactgattgattcaaaacaaatgaagcaatattttgttttaccaagtttatgtattaaagatttaacaattcaaaatattgatgcaaaacaagtaatgacaattgagaatttaacatcttttcatgatctttctttaaatgataatttttacatttatacaaatggttttcataatcatgcgattcaacaatttttaataaaactttatgattttttaggtgatgaagtgaattatcttcattttggtgatattgatgctggtggttttcatatatataacgatttgtgtaaaaagacacatattccttttcaaacgtatcatatggatgtagatacgttaaaaaaatatgatacatatacaaagaaattaactaaaaatgatagaaaaagattaaaatctatgaaaaataatgaagttattacttatatgttaaaaaataatgttaaattagaacaagaaataataggagatagctttagtgaaagatgaaacactaatacgtttagaaagtttacagaagattgtctttcattcactagctaatttggctatctatatctatagagacaagcaaactttaagaatgctaccaatggaatgataataattacgatttacagcatataaaagaagaattagcagatgtaattatttatagtcaggatttattagacaaacttaatttagatgttgatgaaattgttgatatgaaaatggcaatgaatgaaaagaaatatccaattaaataagagttgaaaatggcagaatatgtcatttttttcttattttgtgattatttgcaaaaaaatataattcagtatataatttgcaagtcactaaggaggaaaaatataatgggagacgctatcaaattaatcgggatagttattgttatcattggttttgctttaaaatttgatacattagctaccgtagttgttgctggtattgttacaggtttagttggtggaatgtctattatggatattttatcaacacttggatctgcctttttaacaaatagaacagcaacgttatttattttaacattgccagttattggattatgtgaacgtatgggtctacgtgataaggccgttgattttatcagtggcattaaaagtgcgactacaggtagattattatctatttggcaagttattcgtactattgcttctgcattttcattacgtattggaggacatccacaattcattcgtcctttaattaatccaatggcacaagcatgtgcaattgctaaatatggagaagttgatgaaaaaactgaagacgaaattaaaggaatggctgctggaacagaaaactatgggaacttctttgctcaaaactgttttatggggtcatcaggaactttattgattgtttcaactttaaatgaaatcttcaaatcaaacaatattgctcaagaagtaactgctaatcaaattgctttaaattcaattccaattgctgttatttcagttatcgtggggattggttatgctttatggtatgatcgtaaattaaaaaaacgttttagtaaaaagcaaggaggagaaaaatagtatgttagaaatagattggaatacaagtacaattttagcagaagttttctattgtattattggacttatttttgcttttactggagtcaatgctttaaaaaataaagaagttgaaaaacgaacaacaacagcaatcttttggtttattttagctattactttcattgctgggccttatattcctacatggattacaggagcatgtattattgttttagctatcttaactgctactggtttagtacaaccagcagcaatgcatattcctactgctaaagaaacaagagaaaacgcagataaatatggatataaatcatttattccacctgttgttttagctttatcagcagtagttgtggctacattctttacagatttaggagcaaacaatgccattggtattagtgctgctattggtttaattgttgcttactttattttcaaacctaaattttctttaccatttaaagatggtattcgtttaactgataatgtaggaactacaggtattttacctcaagttttagctgcattaggttcattatttacagctgcaggagtaggtgctgttattgctgcaggagtaggtgctattattcctgaaggaaatcattttattgccgttgctgtttattgtattggaatggctttatttacaatgattatgggtaatggttttgctgcctttgcggttattacagtgggtattggttatccattcttaatcgctcaaggtgctaatccggttgttgttggtgctttaggtttaactgcaggatattgtggtacattaatgacaccaatggcagcaaacttcaatattatgcctgcggctttattggaaaccaagagtaaatatgctataatcatttcacaattaccagttgcgttaattatgttagcaatacatattattttaatgtatgtattagctttctaggaggaaatgaaatgaaattattattaacagcatttgatccttttggaggagaaaaaatcaatccagctttagaagctgtcaaacgtgttcaagacaaaattggtgatcttgaaatcgttaaattagaagtaccaactgttttctataaatcaattgatacagttacaaatgcgattgaaaaagaacatcctgatgtcgttttatgtattggacaagcaggtggaagatttgacataacacctgaaagagttgctatcaatattaatgatgcacgaattcctgataatgaaggaaatcaaccattaagtggaccaatctttgaagatggagaaaatgcttatttttcatctttaccaatcaaagcgatggttgctgaaattagaaaagcagatattcctgcaagtgtttccaattcggcaggaacttttgtatgtaatcatctaatgtatggtgttctttatacaattgctaaaaaatatccatcaatgtgtggtggatttatgcatgtaccatttattacaagccaagttgttaatcgtccaacgaatacaccaagtttatcacttgatacaattgttaagggaattgaagctgcatgtaaagccattgctgaaaattcagaagatattgttgctgttgaagggcatacacattagttatcaaaaactagggttagaaataattctagtttttttattttgtctaaaatattttgttgaaatttgcaagataatctattaaattatttatagggttattctcatttgaaaataacggagggcttatgttagattcatatcaaagaaaaatagattatatgcgtatttccattacagatcgttgtcattttcaatgtgcttattgtaaaagtgatcatccacgaaaattaaaacatcaagatattttatcttatgaacaattattactcattgttgaccaagctatccaattaggaattaataaatttaaaattacaggtggggaaccaacaattagaaaagattatcttttctttattaaagaattaaagaaaagagaggtagaagtaactttaacgacgaatggttctttatttactaaaaaagatttagattgtttgaaagaaataggaatagatggtattaatttttcaatagatacactagatttaagagaatattttttattgacgcaacaggattgtttggaaacagttttagataatttgttttatgcttatcaacttaaaattcctgtaaaaattaattgtgtgatggatgatacttttcatttaaagcgtttgaatgatctaatggatttgattaaagataaaaaaattgcagtgcgttttattgaactcatgcctttaaatagagaacaacgaaatcaaaaaataagagatgttataaagtatttaaagaaatatccaattcaagaatatctagataaattaggaaatggcccagcacattattatacgatagaaggttatgctggttatattggttttattgaagcattacattataagttttgtcaccaatgtaatcgtcttcgtttaacaagcacaggaaagatcaagccatgtttgttctatgaagaaatgtatgatttgaagccatatcttaataatgaaaaacaattgcgtttacatcttgaaaaagcaattaaattaaaaccaaaagaacatcatttcgaagaaaatatttcttatacaagaatgaatgaaataggaggataatatggattttacacactttgatgaaaatggaaatgctattatggtggatgtgtcttccaaagacactactcaaagaagtgctattgcttatggtgaaatttatgttggtaaagaaatacttgagaaaattgtaaatcatcaaatgaaaaaaggtgatgttctttcagtggcaagaattgctggaattatggcagtaaagaaaacgagtgagattattcctttatgtcatcctttacttttaagtaagattacagtggactttaatattaatcatgaaaaagaagtgattgaaacttattgtaaagttacatgtctaggaaagactggggttgaaatggaagcacttcatggcgtgagtgcaaccttacttacggtttatgatatgtcgaaggctgttagtaaagaaatggaaattaaaaatattcatttagttagtaaaagtggtggaaagagtggtgattttaagtggcaggaaaagtaaaagcaatctgtttaagtgaaaaaaaaggtacagcaaaaatacctgttgaaaaaatcgaagttattgaaaattatggttttaaaaatgatgcacatgcgggttcttggcatcgtcaggtttccttgttatcttatgaaacaagggaagcgtttaaacaaatgggttctactgttgaagatggttcttttggtgaaaatttacttatttcaggaattgattttaatgtaattgaagtaggaacctgccttaaaattggtgatgttatccttgaaattactcaacttggaaaaagctgtcataatcactgtgccatttatcatcaagtaggaaaatgtattatgcccacaaatggcttattttcacgtgttttaaaaggaggaacgattcaattgaatgattcagttgaagttttaaaagaaaaagataaacgtttgcgtgtggcaattttaacactttctgataaaggtagtcagggcttaagagaagatttaagtggcccttacatccaagattattttaaagaaagaggatattatgtcacttcttatgaaattcttcctgacgaacaagatttaattgaacaagcattgattaacttatcagatcgttgtcataatgatttgattattaccactggtggaacaggattaagtatgcgagatgttacaccagaagccacactaaaagtagcaacacgaaatgtaccgggtatcagtgaagcaattcgctatgaatcaatgaaatatactaatcgtgctatgctttcaagaggcgtatctattttaagaaaccaaacattgattattaatttgccaggaagtttaaaagctgttaaagaaagtttagatattattattgatcctttaaaacatgggttagaaattttaaaaggagaggcacatgattgtgctcgaaatgatggttgatttatcacctctttatgtttctttaaaaacagcaattattacaattatcattactttctttttaggtttatttcttgcaaaatggacattgaatcgaaaacatgatttaacgaaaattattttagatggtatttttaccatgcctcttgttttaccaccaaccgttatgggatttttcttgctaatgatctttggggttaatcaacctattggaaaactgttctttcatgtttttcattataaaattgcttttagtttttcagcaacagttattgctgctgtcgtgatttcttttcctctaatgtatcgtagtgccaaagcggccatggaacaagtaaatcatgatttgattgatgcaggaagaacactgggaatgtcagaaaaacgtattttctttacagtcattttacctgaagctatgccaggtattattagtgggggtgttttatctttcgcgagaggtttaggggaatttggagcaacggctatgcttgcaggaaatatagttggaaaaacaagaactttacctttagcggtctatagtgaagttatgtcaggaaattacgataatgcaggtgtttatgtttttattatcgctgttatttgcttaatagctgttattggtgtcaatatttatcaatactctcttaagaaaaaaaggagtttttagatgaaattagaagttgtaatttttaaaaaattggcagaatacgatttagatgtctgttttgaaagtcatgaagaccgacttgtcttaatgggaccaagtggaagcggtaagagtatggttttaaaatgtattgctggaattataacaccggatgcaggacgtattgttttagatgatgaagttttatttgacagcaatttaaaaattaatatttccccacaaaaaagaaaaataggatatatgtttcaaaattacgcattatttgaccatatgaatgtttatcaaaacattgctgctcctttaaaagcacgtcacgaagataaacaagtgattaaagaaaaagttcaacaaatcatggaagactttcaaatagatgatttacaaaaaagatatcctcgtcagctttcaggaggacagaaacaacgtgttgctttagcacgtttacttgtttatgatacaaagattgttttgttagatgaaccttttagtgctttagacgaaacactgaaagaacagttacttaatgaaacaaagaaaaaacttgttgagtatcaaaaaaaatgtctgtttgtaacacatagtccaaaggaaatagaaatgatgtgtggtaataaattaaaaataaaaagggggagattggaaaaatgaaaaagttattaagtttaatgtgtagtttattaataattgttactttatgtggctgttcctcaactcaagatcaacaagaagaagtaacattgacacttgctgctgctgcaagtttggaaaatgtgtttgaagataaacttattcctgaatttgaaaaagaaaatccaagtatcaaagtgcaaggagtttatgattcaagtggtaaattacaaattcaaattgaacaaggattaaaggcagatgttttcttttctgcagcaacaaaacaaatggatgctctagttgatgaaaaatacatcaatgataaagatgttgttaatttattagaaaataaacttgttttaattacaggaaaacaaactacaacagaagttaaagattttgcggatattgcaaaagcagaaacaattgctattggtgatcctgaagttgtacctgctggtcaatatgcaaaaatggcattaactcatttaggattatatgatgctttaacttcaaaatatagtttaggtggaaacgttactgaagtgttaaactgggttgcttcttcttcaagtgaagtaggtattgtttattcaacggatgctaaaagcagtaaagatgtaaaagttcttgcaacatgtgaaaatagtttattagctgaacctgttatttacccagttgcaaaacttgctcaaacaaaacatagtgatgaaactgaaaaattcataaaattcattcaaaagaaatcttctttaaaacaatttgaaaattacgggtttactgttaataaataatatgaaagaaattaaaacagaagatgctattggcagtgttctctgccatgacatcacagaaattgtaaaagaccaaagaaaaggtcctcgttttaagaagggccatattattaaagaagaagatattgaagtattattgaatttaggaaaagaacatctttatgtttttgaaaaagatgaaacaatgatgcatgaaaatgatgcagcagaaatattatgtaatctttgtttcaatgaatatatgaaaaaaagcgctattagtgaaggaaagattaaacttacaagtacaattgatggattgtttaaagtaaatcgagaagaactttttaaggtcaattcttttggacaaatgatgattgcgacaagacaaggtaatgtacctgtaaaaaaaggggataaacttgcaggcatgcgtattattccacttgttattgaaaaagaaaagatgcaacaaatccaagaaatagttcaaaaacctattttaaaaatcatgccttatcaaataaaaacagcaggaattattaccacaggttcagaggtttataaagggagaattaaagacacatttacgccagtcatcgtagaaaaattaaaagaatacggggtggaagttatttaccatagtttatcactagatgatcatgaaatgacaactagtaaaatcaatgaagccttaaaacaaggagtggatcttgttttatgtacaggaggaatgtctgttgatcctgatgataaaacgccactggcgataaaaaatacaggtgcaaaaattataagctatggagcacctgttcttcctggagcaatgtttttattaagttataaaggcgatgttccgattgttggattaccaggatgtgtcatgtattcacgtcgaacaatttttgatgttgttttaccaagacttcttgctaaagatttaattaccagtgacgaacttgctttgcttggtgaaggaggactttgtttaaattgtcctatttgtacttttccaaattgtggactttcgaaaggataaaaatgacttataaaaatccacaaaaatttgatttaaagattcgtctttataaccaagaaaaaagctttggtaaaggtgtttatgaactgatgaaaaaagcgcaaagttttggttccttatcaggagcttacaaagatatgaaaatgtcaaattcaaaggcatggaaaattttaaaaagagcggaagaggatttagacatgcctcttgttgaacgtattagtggtggtaaagatggtggtggtagtaaacttactcaagaaggcgaagaattgttagacaagtatgaaaaatttattcaagaaatgaatgaatatgcgaagattcggtttaaggagatttttgaagatgaataaacaggaatatttaattattacttttcattcattagatgatgcaatggatttagacgctaaacaaacagcttctatgaaaggacgtcttattcctaaaccatctgttattgatgcaggatgtggtatgtgtttttcttgtcagaataaagaagtggaaaagtggaagatttttcttgaagaaaatcaaattcattatgaaaaaatagtaaaggttgtgttttaaatgaaagaaaagctttattgtaaaagtggtggctgtagtgctaaattaggcgctaaaaaattaactcatattttagagaaaattgagaaatatcccaattctaatttacttgttggctttgatagtcatgatgatgcctctgtttatcaaataaatgaacatcaagccattgtttcaacacttgatttctttccaccaatggtagaagatccttatttatttggacaaattgcagcaacgaatgctttaagtgatgtttatgctatgggtggaactcctttgacagctttaaatattgtttgttttaacgatcaagatgatttaaatattttaggaaaaatcattgaaggtggaaatgataaactaaaagaagcaaaagttgttttatcaggaggacattccatcaaagatgaatcaacaaaatatggcttaagtgttaccggaatagtagatccaaataaaatgattcaaaataatggtgtacaagtgggagatacattaattcttactaaaaaactaggagtaggtttggcattaaatgcttatcgtttaaatgatgcacgtcaagaaatacttgatgaggtttttaagagtatgacaacacttaataaatatgcattcgatgttttaagtaaatatacacttcatgctttaacggatgtgacaggttttgggctccttgttcatttagatgaaatgctcaatgaaaaggcaagtgcatttttagataaagaaagtattccttattttaaggattgtccttattatgttgatgaattttatttaagtggaggcgctcagcataatcgtaatgcaatgaaaaataaagtttgttttaacgaggaaaactttattttagaagaaattctttatgatccacaaacaagtggaggacttcttgccagtgttgcaagtgatgatatagaaaatattttaaatgattttaaccaagcaggacttgcttgttatgtgattggtaaaatcgttgaaaaagatcaatttaatatttatgtacgttaggagattattatggaaattttagatgctcgaggacttgaatgtccattaccagttgtaaaaacaaaggaattattaaaagaaattgatgaagtaaaagtactcgttgataatgagattgcgattgaaaatttaacaaaatttgcaggagtaagacattatcaaattgttacaggtgatgatggagatgatttttatgcaattattgctaaagaaggtattgatgaagaattagattttaatgaaaaaagtggagatgttgttgttatttcaagtaaaacaatgggaagcaatgaagaacttggtgttgttttaatgaaatcatttatctttgcacttacaaaacaagatcaattacctaaagaaatgattttttataatgaaggtattttccttactacaaatgagggagatattttaaatgatttaaaatatcttgaaagtcaaggtgttgatattgtaagttgtggaacatgtctcgatttctttaaccgtaaagagttattacaagtagggactgtcacaaacatgtatgatattgttgaaagaatggagaaggctgaaaaaattatcaagccataaaagataaatgaaagatttagttattgtaagaggtggtggcgatatcgctacagggaccatttataaactttttaaatgtggatttaaggtcttgattttagaaattgaaaaacctagtgccattcgaagaaatgttgctttttgtgaagctatttacgatacgcaaaaacaagtagaagatgtcacttgttatctagcacatgactataatgaagcaaaacaatttttaatggaaaataaagtgacgttattgattgatccagaggctaaagctattgattatttcaagccagaggttgttgttgatgccattcttgctaaaaagaatttaggaacaacaaaagaaatggctccaattaccattgctttaggtccgggatttatggcaggtaaagatgttgatgttgttattgaaacgatgcgaggacataaacttggaagaacgatttatcaaggagctgctttaaaaaatacaggtgtaccaggtgtcattaaaggttatggaaaagaacgtgttatccattctcctaatgcaggaactgtaaaacatgtaaggcatttaacagatattgttaaaaaaggtgaagtgattgcttacgttgatcaaacaccgatttatgcgacaatggatggattacttcgtggcttaattaaagaaggttttgtagtcactcaaggttttaaaatggcagatattgatccacgtgaagatgaatatgaaaattgttttactatttccgataaagcacgctgcattgctggtggagtcattgaggcaatcttttatttaaaaggacatagaaatgatttatcttgatcaagcagcaaccagttttcctaaaattaaagaagttcaagatgcagtaattgattgtatgaatcattgtaccaatgcgaatcgttctaccagtacgacaagtttaaatgcgagtcgtttgatttatcaaacacgcaaacttattaaagaatattttcatgtacctcaagatggatgcgtggtcttaaatagtggaaatacagaaagtctcaatacatgtattaaaggtattctcaaaaaaggtgatcacgtgattacgacctacgctgaacataacagtgttttaagaccgctttatcaattagaaaaagcaaatattattaccttatctattacctcacctacagtagagggtattaaaaaaaatcttcaaaaaaatacaaaaatgattattgtaacacatagttccaatgtgacgggtgaaatttatccaattgctgaaattggaaagttagcacacgagcatggtattttaatgatgagtgatattgcccaaagtgcgggacatcttctaattgatatggaaaagatgaatttagatattttatgttttagtggtcataaagggctgcttggaaatagtggagttggtggtttttgtttagctcaatctatagaaatggaacctttaataagtggtggaacaggaatggattcttttaatcattttcaaagtgattactaccctgaacatgttgaagcaggaacacgtaatatgacaggaattgtttctttaaaggcaggggtttgttatttaatgaaatatcaagatgaaaaatcaaaatacacaaatgaattagttgaatttttatatgatggtttaaaaaatattccacaagttgttttatatggtgatttcaaagaaagaacaccaattcttgcatttaatatacaaggaatggatagttttcaagtggccgatcttttaaataataagtatgatattgcgattcgttgcggtactcattgtgcacctttgatgcatcaacatctcaatacagtgaaaagtggaatcgtaagagtatcactttcatttatgaatacaaaagaagaaatacaatttttcatcaaagcaattaaagaaattagtgagggtaattatgataattagtgttattggttcaggtggaaagacaacaaaaataaaacagttaaaagatcaatacttaaaagaaggtaagactgttttaatgacaacttctactcatatgaaaattgaagaaaatatactagtcgatccgagttatgaagaaattataaatgaaattaaaaagcatggttacgtacatgcaggtagtaaagccaaaaatcaaaaaattaaagctttagatgatgaagtgttagaaagattaaaaaaagaaatagatgtaattttaattgaagctgatggttctcatggattacctttaaaatatccaagaaataatgaacctgttgtagacaaagatagtaatgaaattattttaattacttctttaaagggacttggaaaacctgttcaagatgttgttcatggttatcaagaaatgaaaattgatggaaatcaaaaagtagatagtctttttattcaacaacttatcaacatctatttagaaaaaattaaaaaatataatgttcccatagaaattcaagtgaatgaagcaagttcgctttatgaaaaagcactagcttcgttattagaaaatcaaaaggaagtaacacttattaatgaagaatggttcttaccacaaccgaaacttgttattttgggtgcaggacatgtgagccaatatgtaagtaaacttgcttctatgttggatttctatacgattgttattgatgaaagaaaagaatttgcatgtaaagaattatttccagaagcaaatgaaattcattgtgtttcttttgataaagctgattcctattttcctaaggaagcaaatacatgttatgtcattgtgacaagaggacataaagatgatcgtttgtgtttaaaaaagacactttttcgacaaagtctttatgtaggaatgattggaagcaagaagaaagttagacaaacctatgatgttttactagaagaaggatatcaacaagttgaacttgataaagtacatgcgcctattggacttccaataaaagcggtaacccctgcagagattgccgtcagtatcatgtctgaaattatagctattaaaaatgaacatcaatattcaagcatgacaagtgacttattagaagtacaaggtgatggtgttttatgtattattattgataaaaaaggatcaacaccacgtacagttggtagtatgatgtttgtcaatgaaaaaggaattattggttctattggtgggggaagagaagaatatcaagctattttagatgctaagaattgtcatgaggtaatgataaaacattatgaattaaataatagcgaaagtgccaatttaggaatgatttgtggaggaagtaatgatgttttatttcttcctataaagcagcattagctgctttttttatgtctataaatctatttttttgtattatcttgatgaaaaaatagagttatgctacaattttcttgtttttagaaggttagtttaaatatgagggagagaatatggagaaaaaagagtatacaagtccttatgattttgaagggaaaattcctttaaaacaggcaattattttaggtttacaacacgttctagcaatgttcgttggtaacttaacacccgtacttattattacgggagcttgtgctgcaacgcatgatgcagatgtatttgctgcaattcaagtttcacttttacaaaatgcaatgcttattgccggtgtggttactttagtacaattattttcaataggtcctattggtgggaaagtcccaattatcatgggaacaagttcagggtttattggtgttttccaaagtgttgctcatgtaatgggtggtggcgttttaggatatggtgccatcatgggagcaagtattattggtggtttatttgaaacggttttaggttttcttttaaaaccattgcgtcgtttctttccatctgttgttacaggaacagttgttttatcgattggtttatctttaattggtgttggtgttgcttctttcgggggaggaagtagcgctaaagattatggatcagtagaaaatcttttgattggtttatttgttttagtagttattttagcttttaagcatggtacaaaaggaatgctaagtaattcggctgttttaattggaattgtttgtggttatgttttatgtatggttttaccattgtttatttcaacaacaggtgttgccagtgatggaacagagtttgttaaatcatgggttttaaattgggataaggtggctcaagcaaaatggtttgctttaccaaaactcatgccagtaaaaccggtttttgatttaagagcaatcctaccagttttaattatgtttgttgttacagctgttgaaactgttggtgatatttctggtgttatggaaggtggaatgtcaagagaagctacagaccaagaattatcaggtggtgttatctgtgatggtattggttcatctattgctgctttatttggtgttttaccaaatacatctttttcacaaaatgttgggttagtaacaatgactaaaattgtcaatcgttttgctttagcgtgtggtgcgattttcctaattatttgtgggttatttcctaaattggcggcacttgtttcaattatgcctcaatcagtattaggtggagcagcagtcatcatgttttcatcaattgttatgtctggtgttcaattgattaccaaagaacctcttactgctcgttcaatgacaattgtctcagttgctttaggattaggttatggtataggtgcaaatagtgcaattttagtgcaacttccacaagctattcaaatgatttgtggagaatcaggaattgtacctgctgcttttgtagcaattattttaaatattttattaccaaaagaaaaacaataaaggagggctttctttgttatcgattagaaattatgtgcgacctcaaacaattgaggaagcttatgaatatgcaaaaaaaccgctgagtgttgttttaggtggtatgttatggcttaaaatgcaaaatagaaatgtaaattttgctattgatttatctgatttgcatttagatcaaattgaagaaatagatgatgaaatacatattggtgctatggttactttaagagaacttgaaacaaatgaacaattaaaccattttacacaaggagctattaaagaaagtgtgcgtcatattgtcggtgtccaatttagaaacttagcgacaattggcggatctatttatggaaggtttggtttttctgatgttttaacactttttatggcacttgattgtgaggtagaactttatccaactgggcgtgtttctatcaaaaaatttgcaaatatgaaatttacaaaagatattcttacaaaagtaattattaaaaaagcaccaacaaacgtagtttatttatcacaaagaaacatttcaacggattttccagttttaacctgtgctgtaagttatattgatcaacattatacatgtatcattggagcaagaccgttgcatgctgtagcgtttaatggagatagctattttgaaacaggtattactgaagaaagtattcaaagttttacaaaatatgttttatcagaattaaaattaggaagcaattcaagagcatctaaagaatatcgtcaaaagattgcaaaagttttaataaaaagagcttttcttcaattaaaggaggatgtatatggaaattaaattaactttaaatggagaaagaattgtacaagatatagaacctgatttattacttattgattttgtgagaaaaaatggttgttatagtgttaaacgcggttgtgatacaagtaactgtggactatgtacagttttattaaatgataaaccagtgctttcatgcagcgttcttgcaatgcgtgcaaatggtgcaaaagtagttactttagaaggattgcaagaagaagcaaagccacttgcaacatttattgctagtcaaggagctgaacaatgtggtttttgtaatcctggatttatgatgaatacacttgctttattaaaagaaaatcctcatccaagtgatgatgaaattaaagaatttttagctggaaatttatgtcgttgttcaggttatgaaggacaacttagaggaataaaaaattacctaaactatcttgaagaaaaggggaatgaataatggcttataaacatattgaaaaagcggtcatgaaaaaagatgctatgaatcttttacttggtaaacctgtttatgtagatgacataacaagtcaagattgtttagttgttaaagtgttaagatcaccacatgctcatgctttgattgaagaaattgatgtttctaaagctcaaaaaatcccaggtattgaagctgtttatacgtataaagatgttcctcaaaaacgttttaccatggcaggtcaaacgtctccagaaccaagtccttatgatcgtttaattttagatcaaagagttcgttttgtaggagatgctgttgctattgttgctggtattaatgaaaaggttgttgatcgcgctttaaaaattattaaagtaaaatatcaagttttaacaccagttcttgattttacgaaagcaaaagataataacatcttagttcatcctgaagaaaattggaaagctttatgtccagtaggtgctgataatcatagaaatcttgtagcaacagattcttcaagtcaaggtgatttagaaaaagtgtttgcttcttgtgatcaagtcattgaaagaacctatcatacaagagcaaaccaacaagcaatgatggaaacttttagaacgtattgtgaaatcgatccttatggaagacttcatgttatttcttccactcaaattgttttccattgtcgaagaattcttgctaacgcattagatattcctcaatcgaaaattcgtgttgaaaaaccaagaattggaggaggatttggggctaaacaaactgttgtagctgaagtttatcctgcttttgtaacatggatgaccaagaaaccttctaaaatgatttatagtcgaaaagaatcacaaattgcctctacaccacgtcatgaaatgcaagtgactgttaaattaggagcaatgaatgatggaacaattcgagcaatggacgtttatactctttcaaatagtggtgcttttggtgaacatggaccaacaacagtaggtttatcgggacataaatcgattccgctttatacaaataatcttgaagcctttaaattttcttatgatgttgtttataccaattgtcaagcagctggtgcctatcgtggctatggcgctacgcaaggactttttgcggtagaatcgattgttagtgaaatggcaggaattttaggtattgacccagtagttattcgagaaaagaatatggttagacaaggtcaaataatgggagcttattataatgaagttgctcaagcatgtacattagacaaatgtatggatcatgctaaaaagctttttgattgggaaaataaatcaaaggtgcgcgtcttagaaaacggtaagattagaagtgctggagtagctatggctatgcaaggatctggtatttcaggggttgatgtgggttctgctacattaaaacttgaagacgatggttattatacacttcatataggcgcagccgatatgggaacaggttgtgacaccattcttgcacaaatggcagctgagtgtttagattgtgatgttgatcatattgttgtctttggagcagatacagatatttcaccttatgattcaggttcttatgcttcttcaacaacttatgtaacaggaaaagcagtagaacaagcttgtgaaaaattaaaaaataatttatgtagccttgctttacaaacatttcattgcgaaaaagaagatgttgaatttacctcacaaggtgttaaaaatttaaagacaaacgaacttttaactttaaaggagcttgctttaaaagcaatgtgcggaaataatattgaaacacaagttacagttacacattcatctccagtttcaccaccaccttatatggtaggaatggttgaaattgaacttgataaagaaacaggacaagtagatattcttgattatgttgctgttgtcgattgtggcactgtcattaatacaaatttagcacgtgttcaaacagaaggtggcttagttcaagggattggtatggctctttatgaagacgttcaatatacaaaacgtggagctattcctgaaaactcttttatgcaatataaaattcctacacgtttggatatgggaaaaattagagttgaatttgaaagtagctatgaaccaactggtccatttggtgcaaaatcgattggtgaaattgttattaatacaccatctcctgcaattgccaatgctatctatcgagcaacgggtaaatatctaaaggatcttccaatgactcctgaaaaaatcttaatggcaattgatgaataatgaaaacatatattatttatttggcggctggaaatagtcggcgttttaaggaagataagttacatgcgctttttaaaggaagagaactttatctttacggcatcgatactttgaaacaattattaaaatatcgtaatgatatagaaattatcattgtttctaataaaattgatatacaagaagaatgtatctatagctataaaagtcctttaagtgaaaaaggaatttcctattctattaaagctgctttagatcatatcaaccaacaggatgactatcaaatgatgtttatggttgcagatcaaccgtatctttcttatcaaacacttaataagatgattgatacatttaatcaatcatcttattctatatgttctttaatgtttaaagatagagttggaaatccggtaattttttctaaagaatattttaatgaattatattctttaaaagaagatcaaggaggacgaacgattgttaataaatatcctcaagaatgtttttattttataattgaaaatgaaaaagagctttatgatattgattatcaaagtgatttacaaaaacttataaaggaagaagaatatgattgaatatgctaagttagaagataaagaagaaatttataatttaatttgtattttagaaaataaagaaatcaataaagaacactttgattgtgtttttgaaaattcattaaaagatgaagatattatttatttagtttatcgtgatgaaaaaatagaaggttttttaagttttaaaatacatcattttttacatcatgaccgtgatacaggtgaaattgtagagttgattgttttgccagaaaaaagaaatttgaaaattggtaaacaattgattgaaaaaattgaagagattgctaaagaaaaacaacttgaacaaattgaactttctacttctacttatcgtaaagatgcgcatcgcttttatgaaagacaaggctatgaaaaattacattataattatacgaaagcactagatgactaaccgtcatctttttttcacatcttttacacatagtcatgttacaataaagttgaagaggtggtagtaatgtataaagcattaatgatagaagatcataaagaagtaagagactttgttaaagagtattttgatcataaagaaatagaagttatagaagctcaaaatggttatgaaggattggaaatattagatgatacaatcgatatcattttacttgatattatgatgcctggaatcgatggctatgaagtttgtaaacagataagaagtcgatataatacgcttattatttttataagtgctttatcagaagatgaaaaccaattaaaggcttatgaatatggggcagatgattatattactaaaccatttaaaccttctttgttgtatgcaaaatgtttagtacttttaaaaagaaataaaaagattgaaacgaatcaacttcaatcaggaaaagcaattttggatttaaataaacatattttagtgattgaagaaaataatattgctttaacagataaagaatttaaacttcttcgatacttaatggaaaatcagggaattgttttatcaagagaaaaaattttagatgctttatggggctatgattattatggggatggacgagcagtagatacgtatatcaaacgtttaaggaaacgattgggaaaatattcttattatattcaaactattgttaaaactggatatgtgtggaaaggagaagaattatgaaaggaataagaagcattcagtttaaggtgtttatttgtttgtttatttcttttatggtggtatttggatatattgtaaagactaaatatgaccaaagttttaatgaactggtttacaatactgattacacggcttcagatgattatattaatttttgcaatactatagatagtagaggacctcatcaagtagaattagatttagaaaaaataaaaaaagaattaagtaatttgcctaaagataatatgactgaaatctgtcttttagatgctaaaggaaaacttatcaatcaatacggatataataaaaaagatcgattacttattacctctgatttatgttcagaaggtgataattcaaacgattattatgatataaattactatattgacttatcagaattatcagataaacaatataaactcttaaaagatacaataaaagatgttgatgaaaaaggttatgatgatattaatttaagttttgaaggtcaaatagaagaattacaaaattttaaagaaacatcgacattaatgtataatgccaagagccgctattttaaagtcacaccaacctttattcattataatacggatatttttggaatgaagcaaggaaactcaattagtgcgacgttatatgcatatgttgatgatggagattatcatttatcgtggcacggagaagtagtcaatgatataaaagaggtttctacattgaaaatgaatcagttaacaaaagatgctatcaataatcatttttctaatatttatgtaagacttgtttcatttttagataaagataccattacttcaaaagaaaataaaaaaatgacaaatgaaattgcgtcgtctattaaagaaggtacactaacatatgcaacttttacaaaacttttagatgattattcttatcaggtattactcacacctttatataagtataaaggatatactgaagggcaagaacacgcaccagaagcttatgttgctattttctatgattttcaaagtggaggaagaaatcaattaagaaatgatttgattaaagataactttccattacttttaggtggtttcttatttatcgttttattttcatatttgatttcttatatgacaacaagacgtattaaagaaattgatcgtgttgcaatggaaatcacaaataataattttgaaggtgtattagatacaaaaggacatgatgagttatcaagtctttcaagtcatattaatacgatgtcttctaacttgaaaagaaatatagatgcattgaatttagaaatagatcaagtgaagaagatggaacaattaaggaaagaatttattgctcaatttacccatgagattaaaacccctcttgccattattaatggaaatattgatttgttagaaaatgtagatgatgaagataaaaaagctaagtatatagaggtgatcaataaagaaattagtgttattaatgatctagtattacaaatgttagatttatcaaaacttgaagcaaaggcgattactttagataaaaaagaaattgatttaagagagctaactgaagatattattgatgattatgaacaattattaatggataaaaaattaaagatagaaatacaaggagaagatgttttaattgtaggtgatagaaaacgaatagaaatggttattcaaaattatttatcaaatgcaatcaaacatgcatttattaatagtacgattaaaattaaaatcaaagaaaatgaattttcgattgaaaataagggaaaacaaattgatgaaaatagaatggacactatttgggaatcttttgtcagtgatgatcaaaaagggacaggtttaggtcttgcaatcgttagaaatattttagaacttcatgaaatgagttatggagtttataatttacaaggcggtgtagagttttattttagatggaaaaaataaatgaaaaccctttcttttaaaaagagttatagaatcgttaaaaaagtcttctttttttcataaattagttccatttaatgaaaaaaaagcatataatagtcattgcttaaaggagagatagtaatgaatataattttaatgggtccaccaggtgctggtaaaggaactcaagctgctaaattggtggaaaaatatggtttaaaacaaatttctacaggggatttatttagaaaagcaattaaagaagaaacaaaatttggtgttattgctaaatactttatttcttttggttatttagtaccagatgattttacaattcaaatgattcaagaatatttagaagaaaatattaacactgaagaatttaaaaatggtttcatcttagatggtttcccaagaacaatcattcaagctagaaaattagctgatatttgttcaatgttcaattttaaaattgatgctgtaatcaacttagatattcctgaagatgtattagttaaacgtttatcaggaagaagaacttgtgctgattgtggtaaatcatatcatatcgtttataacccacctaaaaaagaaggtgtttgtgacgtatgcggtggagaattaatacaacgttctgacgaaagtgaagaagcagttcaagtacgtattgatacttacaataaacaaacaaaacctttaattgattactatacaatgttaggtgaacttactaacgttgatggaaatcaatcaatggatgaagttgctgaagaaatctataaagtattagataatttaaaatagaagctcacgcttctatttttttttcataaaatgaaataagctttcttgtatagacctctatgttataatgaatatgtcaaaaaatggaggatataaaaatgagtaaaaaacctgtaaaaattgtaacaattggtggaggaactcacgaatgccggagccacaatccggtgcgttaaccacttcgccacgtccgccgtatcaactgcatgtattaatttacactatttcgtatactttgtaaagcttttttataaaaatatctacattattttcaataattattatacaataaaaaaaacaaataaatgaaaaggataagtatatgaacgaattagaaaattactatggaaaattttgtgaagataaacgtcttttaaggaagcatggtcaagtagaatatcgtacctctatgaaatatattcatgattatttaaaaccaggtgatcatattttagatattggtgctggtactggtagatattctgttgctttaaatcaagaaggttatgaagtcgatgctattgaacttgttaaatataatttaggcatgttaaaagctaaaaaaagtactgttaaagcttatcaaggtactgctttagatttatctagatacaaggatgaaacttttgatataactttattatttggacctatgtaccatttgtttagttatgaagataaattaaaagcattatctgaagcaaaacgtgttactaaaacaggtgggactattttagttgcctatgtcatgaatgattatagtgttttagtgcacggctttagagatggacacattaaagaagctctaaaaaacggaaaaattgatcaaaactttcaaacacaaacaaatattgatgatttatatagttatgtaagaattgatttaattgatcaattaaatcaagatttgaacttagaaagaataaaaattatcgcggctgatggtccagcagactatatgcgtcctattttaaataaaatggatgatgaaacttttgaactttttatgcaatatcatttatctacttgcgaaagacaagatatgataggtgcaagctcacatacattagatatattaaggaaggtgtaattatggcaattattcaattaaattatttatcaaaagcattacttagaacagttgatgtcactgttatcttaccaaccgatacacttgacatggaaaatatgacatatactaaaagaaaagagtataaaacactatatttactccatggcatctttggtgatcaaaatgattggctttatggtactcgtattcaaagattcgcaaatgaaagaggattatgtgttgttatgcctagtggtgaaaatatgttctacgttgatcaagcaaacacccataaccactatagtcaattcataggtgaagaacttgtagaaatgacaagagccatgtttcctctttctaataaaaaagaagatacttttattgctggactttcgatgggtggctatggagcaattgttaatggattaaagtattatcaaacatttggctatatcgcaggactttcaagtgcattaatgttagaagactggcttgattgtaaaccacctatcatacaaggtgttgatgctaaaaaatattatgaaagtttatttggtgatataacaaaacttaaaggtagtgataaggattactatgcattaattaaacaaattccacacgatcaattacctcacatgtatatgtgtattggaactgatgattttttacttgaaacaaatagaaaatatcgtgattatttacttcaagaaaatgttgatttaacttatgaagaaggacctggaaatcatgaatgggatttttgggatcgttatattttaaaaattttagactggcttcctttaaataaaaaagatgaaggtttaaatagtggtcacgtaagcaaataagagcaggataacctgctcttattttaaatcaatgtttgattaagtccccaatgatcaaattcatggaaaataacataaatattatcagcttcgattttcgttgtttcatgaatcatttgaatcattgcttctgtaagcctttttttatcctcaaactctgcacttttataaagattaatttcaatcatcatacaagttaattcttcccctttaaagtacataatttgatcatcttccatatgaatcattaatgatttttcaaattttccaggaattaatgaaataagttcacctgtcttagattttataatattttcttgtcgtaatgttaatttgtgatttgttttcaatgatatatatggcataataattcctcctttctattattttatcattaaaaaaataaattgaaactgtttacaaaatattttttgtaatgatataatagacatgcaaaggttttatataattttctaaaatatctcaaatatgaaggaagttgtatttcactttatgtacacaatctcatatttgcgattttatacatagagtatttccatttgtaatatttataggaggtaccagacatggctgtcggaaaagtaaaatggtttaattcagaaaaaggttttggattcatcactagtgaagaaggaaaagatattttcgttcatttctcagcaattcaagctgatggatacaaaacattagaagaaggacaaactgttgactatgatgtagttgaaactgatcgtggtccacaagctcaaaacgttgttgtaaaataacaaaaaagaaagctgatacgaataatcgttcagcttttttattttatcgataaacaacaactggtaaattaacataaatttgtgaatataagcttccagcaaatcctgttggtaagttaatacatccatgtgaaccgctattaatataaatatttccaccaaatgtacttctccatgaagcatcatgtaatccaatacctttattaaatggcatccaatatgaaactggtgattcgtattcatatttcccatttggttgttttgttcctcttaaaactctatttctttccttattataaatataatatgtaccatttggtgtaagtcttgaaggatcactttctttaccacttacaaaatcactttctagagcaaccgctccatctttaacaagccataaatgttgttttgtaatattgatttctaaatatgtcgttcctagtccaccattttctcctgatggaagttgtcctgtatgttcaggtgttctattattttcacttttattttcattgatcatttttaataatgcacttacttcactatcagtagaaactctaaatccataagttcctccactgactgtgtgactttgtccatcttttccagtaaacgttcttgttgcgccaatggaattatattgacttgcaagttctttaacaaagacagttaatttttctttaaaaacactttcatcttttgtataacttccatcatcttgtttacttaaccaagtaataagtgtacttccatctaaagcaatttcttttcctttaggtgttgtatatgtaattgttgataaacaatattcatttgctgcctttaattggttattcaaatcttgatcatctttgtaaacttgaggtttaacataaccattagcttttgtaacatctaattgttgttttccttcacttaaagctaccttgatatttttaactaattcttcagtattaaattttgatcctaacgtttcttcaataattgaaaaacttccatctttatattgaatataggcatctgttggtgcaatttgattttcttctttagcatgttccattgatgctataccatttgttaagttttcatcactgatttgtattaaatcagttaaagtatttttttcatttttaaagaatcctataaaccaagcccatttattttgatttttcattaattgattcaatgaattatctttattataagatacacctaattgagctgattgtaatacttcactttgtccatcattaaaaatcaattttaatgattgtccatttactttcttagataattgatcatttgctttttgtaatgtcattcctccaacatcactcccattgaccattgttccatttaaaaacttatcattgtaatatagcattcctgccaaataaacaacaagaagaaccaaaacaacaattccgcaaattaaaacaggctttttatgattcgaataccaattattcttcttttttgtcataaatactctccctctcttacatttccgcacctattttatcacaaaatatttataggtaaagaaaaagtatggtatttatcataaaaaatgataatccatacttttataagatattttctatatatttttctaactcttgtatattttgatgataaacaaagcctttcataccaacttttatagctgcgtctatattttcttttaaatcatcaacaaaaaggcattcattagcttttagatgataacgacttaaaaaatcttgataaatatctaaatttggttttattttttgatattttgcagatgtataaagctctttaaaatgttgaaaaatagattttgattgataatattgataaaattgcattgagcaattagacaacaaataaaattgatatcctttacccttatatcttttaataaattcttccatttcatcaaactgatcaaaataatcaaaccaatgttcaaaagcatacacaattaaatctcttttttcatcaggaatttgttcaattaattgttttttggcatcttgtaaagaaagaaccccttgatcaagttgtgcccattgttttgtttggaataaatgtttaataatataatctttttcttctaaagaagatgcaagctgacttgcaatataggaaacatcccatttacaacagacatttcccatatctaaaacaatattttttatcatatgtaaaaaataggcaaactgcctattataataaaggattaagtttttctaagataacatcttttccaacaaaaccactaatttgatcaacggcttgaccatctttaaaaagaattaaatgcggaatagattgaattccatatcttcctgctaatgaaggatcttgatcaacatctacttttgcaaatgtaactgttggtacctcttgagcaacttcttctaaaacaggagctaacattttgcatggtccacaccaattagcaaagaaatcaatcacaacaacacctttagaaacaacttcatcaaattgtacatttgtaataatttccataatttcacctccattatattatgccaaaactctttttttttacaagtgatatgcttatattatttgaattttatcgctataactgttattatgtgcttgtgattatactagaaatggagtggtattatgaaaaaagtcgcagttgtgactgatagtaatgcaggtattcgtcaaaaagaagcaaaagaacttggtatttttgttttgccaatgccttttactattgatgatcaaacatactatgaagatataaatttaactcatgaagaattctttgaaaaacaattaaatggtgcagaaatctttacttctcaacctgttgtaggaaacgttaaagaattatgggatcaaattttaaaagattatgatgaaatcgttcatattccaatgtctagtggattaagtggttcgtgccaaacagctatgatgctagcacaagaatacgataatcgtgtttttgtcgtagacagtcaacgtatttctgttactcaaaaatacgatgtcattgatgctaaaagattagctgatcaaggaaaatcaggacaagaaatttgtgatattttaactgaaaataaattaaatgcttctatttatattactgttaatacacttgattatttaaaaaaagggggtcgtattacccctgctgctgctttattgggtgggatgttaaaaattaaacctattttacaaatacaaggtgaaaaattagattctttcgctaaaactagaacaatggctagaggaactaaaatcatgaaagaagcaatcgctaaagatattaaagaacgctttgatgatgactatcataacgtgcatatttgtgtcgcttacacttatgatgaagcacccgctttagaattaaaaaaagaacttgaagaactttatccaggtgaaaatattatttgtgatcctttatcattaagtgtttcttgtcatattggacctcattctctagcaattgctatatgtaaaaaaatttaagattctcgtttgagaatcttttttatttttgggtataataatttgacttttttcattttgatagtctataatacattttaagtttatgctataataaaacaaaaaatataaggaggtcatttatgcaagaaaagccaatccataataaatataatggcaataaaaatacaaaaaataaaaattttaatcgtcatagatcaacacataaaaactataaaaatacaaaacataataaaacaatcgatactaaagtttatgctttaggtggtttaaatgaaattggaaaaaatatgtattgtgttgaacacgataatgaaattatcattattgatgctggggtaaaatttgctgaagaaggtttacctggtattgattatgtcattccagattatagttatttaaaacgtaatgaaaacaaaattagaggattattgattactcatggtcatgaagatcatattggaggaattccttttttactacaagttgtaaaaataccattcatttatgcttctccccttgcttgtgcgatgattacaagaaagttagaggaaaagcgtttaacaaatgcaacgcacttgattcgtatcgatgatgaatatcaaataaaaacaaaatattttaatattggtttttttaaaaccaatcattctattcctgaaagtttaggaattattattaattctcctaacggacgaattgtttcaacaggtgactttaagtttgatttaacacctgtaggagatcctgctgatttccaaaaaatgtcgtttttaggtgaaactggtgttactttattattaagcgattctaccaatgctgaagttcctactttttctaaaagtgaaaagcaagtagcatatgctgttcaagaagaatttagaaaaactgaaggacgtttaattgtagcaacctttgcttccaatgttcaccgtgtccaacaaatcgtagaagcagcagttaaatttaatcgtaaaattcttgtttttggtcgttcaatggaaaataacatccaagtatcaagacaaatgggttatattaaagcacctgattctttctttatcagtaataatgaagcaaaaaaattacctgataatgaaatcttaattctatgtacaggaagtcaaggagaagctttggctgcgttaagtcgtattgctaatggaacacataaattcgttaaaatcaaacctggagatactgttgtcttttcatcaagtccaattccaggaaatgcatcaagtatcaatgttgttgttaaccgcttatttagagcaggtgccaaagttttagtcaatacagcattcaataacttgcatacttcgggacatgctagtcaagaagaacaaaagttgatgttattacttacaaaacctaaatactttttcccagtacatggtgaatatcgtatgttgaaaattcatgctgaattatctcaagaagtaggtgttccaaaagaaaattcttttgttttaagtaatggagatactattttattaaataaagggattgctcgtttaggaccaagaattcatgtagatgatatttatgttgatggtaatgatctttcaggtttatctacagctgttttaagggatcgtcaaattttatctgaagatggaatggtttctgttttaatttctatggattctcatgaaggaaaattattaactaaaccggttattatttcccgtggttttgtttatatgaaagatagtttccctatgattcgtgaagcagaaaatttagtaggtcaagctttaagtcaattacttgcaggaaaaacaacttttggtgaaatcaaaaatacaacaagagatgttctttctcaatatttttatcgtaaaacaaaaagaaatccaatgataattcctgttataatgaataaaaaataatgaataaaattaaaaaaataattttaattattctttcttgttttttagttatttgcctttatcaatggtatattcaaagtcaaaacacatatcattttaaagaaaccgcatttactcaaaaagcattaccaaaagaatttaatggttttacgattggttatttttctgatttaaatctttcttctaaagaagatttaaatcacttaaaagaagctgttaaagatttaaataaaaaagatgttgatttaattttatttggtggagatatttatagtaatgattcatttgaaactgatcaagtaagtcaaatattaaaaaatatacactctcgttatggtaaatttgctgttttaggagaaaaagatcaaggtgattctactaataatacaaatttattaactgaagctggatttgaagttttgcataatgaattacgttatatttattataaaggttctattattgatttattaggattagaaaattccggtgattgttcaggtttaatcagcgaagacaataaggatcattataaaattgctttagttcatcaacctgattattttacacaaattaaagaaagttctgtccaacttcaattatctggtcatactttaggtggatactataagattccttttattggcggattagaaacaaaagaaatgggtaaaaaatatgtaagtggtaaacatactaataatggaactacccttctcatttctaatggttttcataaagaatcaaatgatcaacatcgttttatgacatatgatgaaatcaatattataaagctaaaaaaatagaactcatatttgagttctattttttaatcattgttccaacaccttttttagtaaagatttctattaataagctatgttctaatcttccatctaaaatatgaacacgtttaacatcattttgtactgcctctaaacagtttttaagttttggaatcattcctccagtaataataccactttcaaataattctttagctgattcagtatcaatttttgaaatcaatgtttctgaggtatttggatcttctaatacaccttcaatatccgttaagaaaacaagtttacttgctttaacagcacgtgcaattgctgtagcaacatcatccgcattaatattataagcaagatatttttcatctaaaccaattgttgaaataatcggtgtatacccttgatctaataaagtattgatgagtgtagtatccacacttataattttccctacaaaaccaatatcttcaccttgaggcataaccttttctaccgtaatcatatttccatcttttccagataatccaacagcatgtgttccaatttgttctaaatgtgttacaagacctttattgatttttccagataaaaccatttccgcaatttctaaggtatcacgatctgtaactcttaaaccatttttaaattcacttttaatttgcacacgatctaacattctattgatgtcttttcccccaccatgtacaataattggttttaaccctacagatttcaaaacagcaatatcttttaaaacgctttttttgatgatttcatttgtcatggcacttccaccatatttgatgacaacgatatcaccttcatatttttgcatatatccaagcgcttctactaaaatttccgctttattaatttccttcttaaactcttgttgcatctcttttccccctacgaacgataatcagcattgattttgacataatcataagtcaaatcacatccccaagctgttgcctttgcatcagcaattttcatttcaatatttgtttttacataatcactcgatagaatcttagttgcaaattcttcactataatctgtagccatcccattttctacaagttttaaattaccaaattcactttctatatataaatctacctgataaggatcaaattcttccccagaatatcccatcgcacataaaagtcttccccaatttgcatcatttccaaaaatagctgtttttacaagtggtgatgtgcaaacacttttagcaactacttttgcttgtttaacatcttttgcaccatttacatttacttctaataatttagtagccccttctccatcacttgcaatacatttagctaagtattcattaacataatataaagcttctttaaatgtttgataatcttcatcttcttttacaatttcatcattaccagctaaaccattagcgagtaataaaacagtatcatttgttgaagtatctctatctacagaaatcatattaaaagtatctggaataactgattttaatgctttatttaataattctttagaaatatttaaatcagttgtaataaatccaagcattgttgccatatttggatgaatcatccctgaacctttacaacatgctccaatagttaccatttttccttttacttcaatttcaacagctaaatgttttggttttgtatctgttgtcataattgaagtagctacatcaattcctgcttgatgatcatcttttaattgttttaaagcttcatcaattcctttttcaattggatcagtagataattgtttaccaataacccctgttgaacaaataagaactttttctttttcaacatttaaagcatttccgacaatacttgcaaatttttcatttgcttgatttccaagttttccagtacaagcattggcaatcccactgttaatcgcaatagcctttactgtatcactgttttctacaacttgtttatcccataaaacaggagccgcttttaccatatttgttgtaaaagttcctaccgcttttgcttcaacatcagaaacaattaaagcaaaatctttatttttctttttaataccaatatgtaatccagccccttgatacccttttggattagtaactgttccatcttctattattttcatactctttttccccttataaaaccgcaggtgctaacataagacctgtcttttcatctaaaccaaacataatattcatattttgaattgcttgaccagcagctcctttaactagattgtccatggctcccatcataatcactctatgtgtacgaggatccactttataagcaacatcaacaaagtttgaacattttacatttcttacttctggaacatttccttcttttaagacacgtacgaaatattcatctttataaatatcatacgtttttttaacatcttcctcacttactccttcttttaatgaagcgtaagctgtaattaaaattcctctattcattggaataagatgaggtgtgaagttaagtaatacttttgatgaagaaacataccctaattgttcttcaatttctggtgtatgacgatgacttgctacaccataagctttaatactttcattcacttcacaataaagattttgaacttttgctcctctaccagcaccacttgttccactctttgcatcaataatcaacgtatccatatcaataagtcctgctttagcaagtggataaatcgataaaatagaacatgttggataacatccaggattagcaatcagtcttgcatttttaacatcttctctattgatttcacataatccataaacagcttcttgaataaattcaggtgaagcatgcttaattccataccatgactcatatgtttctacatctttaatacgataatctgcagatagatcaattactttcactttctttaaaacttcttcacttaccatcttagcgcaaaccccttgaggcgttgcaaagaatacaacatctacattatctaaatatttttcaatatcttcatctacacacttttgatctaataaagtgaaataccccttataaacatcactatattcttgatcactatatgttcttgatgaaacccattcaatatgaacatttggatgtgttaataaaaatctaacaagttcacatcctccataaccagttgaaccaacaattccaacattaatcattctacttttccccctataaaaaataaaaagccgtctctaaatagagacgactgatcgcgttaccactctaattgttgtaagttgaccttacaacctctttcatctttaaggcagatctaccaaaagatatacttaatttccatcttttctctcgtaaatgcgcttcatctttacttccattcctatcttccatcaacataggatcgctcttatttccataaagactactcttttagtcctcgagtttaaaatcattatatgacaaatttccattttgtcaataatgatttattaagaaaaaaattttttatatataataaagatacgtttacattttttaacatccaacatttcgacaaggatattgcatatttaaaaaaagtagtttatgataataataatttataatataaaaacaagggggaaactataaatgaaagaaaaagttgttttagcttattctggcggattagatacaactgcaatcattccatggctaaaagaaaactatgattatgaagttatttgttgctgtattgacgttggtcaaaaagaagaattagatggcctagaagaacgtgcaaaagcttgtggagcaagtaaactttatattgaaaatgtggttgatgaatacgtagaaaattacattatgcctactgttcaagcagatgctgtatttgaatacaaatacttattagggactgcaactgctcgtccattaatcgcgaaagtattagttgatgttgctcgtaaagaaggtgctgttgctatttgtcatggtgctactggtaaagggaacgaccaaattcgttttgaattaggaattaaagctttagctccagatttaaagattatcgctgcttggcgtgatcctaaatggacaatggattctcgtgaatctgaaattgaatactgtagagctcatggtattaatttacctttctctgctgataatagctattctcgtgatagaaatatttggcatatttctcatgaaggattagaattagaagatccatcatgtgctccaaattatgatcacttattagtattatcaaattctccagaaaaagctccagaagaagatgttcacttatcaattgattgggaaaaaggtgttcctgttgctttaaatggtgaaaaattatcacaaagagaaatcttagaaaaattaaatgaaatcggtggtcaacatggtattggtattattgacatcgtagaaaaccgtgttgttggtatgaaatcaagaggtgtttatgaaacaccaggtggtactatcttaatggaagcacatcaacaattagaagaacttatcttagatagagaaacacttaaatataaacgtcttgtttctgttgaatttgctgaacttgtttatgctgctaaatggttctcaccacttagagaagcactaactgcttttgttgataaaactcaagaatatgtaacaggtacaacaaactttagattatataaaggtaatattattaaagaaggtacaacttctccttactcattatatgatgaagatatcgcttcatttaaaactggtgatttatacgatcatcatgatgctgaaggattcattactttatatggtctttcaactaaagtacgtgcaatgaaattaaataacaaaaaataaaaagagcccactgctctttttatttaaaggaggaaatttatgaatttatggggtggaagattcactaaacctacaaaccaacttgtttatgattttaatgcttctattaaatttgataagacttttgccagtcaagatatcaaaggaagcattggtcatgtaaaaatgctaacaaaacaagaaatcttaacacaagaagaaggtcaactcattgaaaaaactttaaaagaaattttaaatgaagttgaaaatggaacattagaaattgatgaaagctttgaagacattcatagctttgtagaatctacattaattgatcgtattggtgatactggtaaaaaattacatactggtagaagtagaaatgaccaagttgctttagacatgagactttatacaaaagatcaaatcgaaatgttgaatactttacttgttgatttattaaaaactattcatgaaatcatgaaagaacatgtcgataccatcatgcctggttttacccatctacaaaaagcacaaccaattactttagctcatcatatgggagcttattttgaaatgtttaagcgtgatcaatcacgtttacatgatatttatgaaagaatggattattgtccattaggttcaggtgccttagctggaacaacatatcctctagatagagaatacagtgctgaaatcttaggttttaaaggaccttgtttaaatagtattgatggtgtttcagatcgtgattatttaattgaacttttaagtgcgatgtctactatgatgatgcatatgtctcgtttatctgaagaaatgattatttggaataccaacgaatatcaattcattgatctagatgatactttctctactggttcttctattatgccacaaaagaaaaaccctgatatttgcgagttaattagaggaaaaacaggacgtgtttatggtgctttaatgggatttttaacaacaatgaaaggtttacctcttgcttataataaagatatgcaagaagataaagaaatgtattttgatgctttaaatactactaaaggttgtcttcaattattaagtgatatgttaaaaacaacaacatttaataaagaaaaaatgaaaaaatcagcaactggcggttttacaaacgctactgatgctgctgattaccttgtcaataaaggtgttccttttagagatgcacatggtattattggtcaacttgttttatatgcaattagtcaaaataaagatcttgatgaattaactttagaagaatttaaaaatatttctgatgtttttgaagaagatgtttatcaagcaattgatgttaatacgtgcgttaacaaaagaaatactataggtgcatgtggtcaagagatgatgaaaaaagttattgctttaaatgaagaatacttaaaacaattttaaaaagggcgtttgccctttttcttatgctcttccatattttatatgataaagcgcttctaataattcaaaaatgtacgtaatcgaaaacttaccaatcaaagataaatgatctgttcctacttgaataatcatatcaaattgctcttgatatggtatattttctacttgagtaatacatattttatgtgctctactttttgcaatctctcttaacatatctggatgatcttgccaataacctcctgcaatcgaagaaacaataatcaaatcatttactgttaaatcacgaaccacttctttttgactttgtaaaggatacattcctgtacatttctttcctaaataggataattcaatttgtagttgcatggaaacagattgggtaaaaaagttacccgcaaaacaaatttcattactttgataaataagatctaccagtttttctaattcttcaaattcgatcatttcataagttgatcttaagttttgtacaatattttcaaaatgatcattaaataaatctttagttgtttttcctgcaactggtaaaacaggaagttgatggtcaaattgcatacgcattgaatcatgattaaaataacgtaaattcatggtcacatccattttaaaatcactgaagctttcataattaagttttcgacatagtcttgaaattgttgctgtagaaacaaaacacatttctgcaacatctgtaatatttaactctggtattttattaatattttctaatatctttttagctgcatttgcataaacatcatctactttagccgtattaataaaattaattaaattataaaaagcactacgcatgattaacctcactcattttgattacaaaaactttatcatcatctaaacatatacaattcagttgtcctctttctcctaaagcaagaccaccatctatacctatcttattatgaaactcatcatcataccaaacatcaaaacttttatctcgattaataaaacaaagtggtgtatgtccaaaaatatatgtcttttttaagtcacattcacttaaaaagaaataatctcgaatccataaaagcgtatcttcttcttgatcttctaatgaattttcgggatctattcctgcatgtactaatacataatctttatgattaacagtaagttcaatatataaaggtaagtttttaagataattataaagatttctcaaaaagacatttcttacaattgtataatcacaatgatacaaattctttttacataaataatttcgaatattttctattgttttttctccaccattttgtgcccataatttaaattcacaactaggaaaatcaaaatcattatgatcaattgcttcttttaaagcttcttgcatcatatattcatgattgcctttaagtaaagtaatattatcaaacttttgaatataaaaatagatatctaaactgcaaggtccgcgatcacaaatgtctccaagtatataaagttgatcatgactattaaattgtattttttctaacattcttttaaatatttcaaaattaccatgaatatcagaaagtacatatgtcttacctttcatattgatcacctaaaattatcatagcacaaaattaaataatttgcttaaaaaagaaacaaatttaaaaaagatgcctaagcatcttttccaattgttgcgaccatgacagctttaattgtatgcattctattttcagcttcatcaaaaactacagaattttttgatctaaagacttcatcttcaacttctcgaatatcaataccttcttcatgttttgtttttgctacagttgtttcaaaatcatggaatgaaggtaaacaatgcataaataaagtcgaatccttacctgttttactcatcatttcttgagttactttatatggtgataacatttctactcttggtttatataagctttcatcttcccccatacttacccaaatatctgtataaataacatcagcttctttaactgcttcatcaacattatctgtcacttcaattgttccacctgattttttagcttcttctttacaataagctaaaacttctggatcgatatgtaatgattttggacctagacaaacaaaatgcattcccattttaacagctccatacattaaaccataacatacattgttacgaatatctccagtaaagacaaatttaatatcttctaatggtttatctaaatgttcttcaattgtaagaaaatcagcaagtgtttgtgttggatgatcaacatcagttaagccattccaaactggaactcctgaatatttagcaagagcttctactgtttcttgtttaaatcctctaaattcaataccatcatacattctacctaatactttagctgtatcttcaatggattcttttttccccatttgtgagttacttaaaaaagtagcatgtccaccttcatctaaaacagccacttcaaatgaacaacgtgttcttgttgatgttttttcaaaaatcaaacatacatttttccctaataaatattgtccaattttccctgcttttttatctgcttttaattgatgtgctaaatctaataaatatctaatttcttctttagaataatcttttaatgttaaaaaatgtctatttttaagattcataataatcccccttttaataaccattattttatcaaaacattgatatttcttcaatattgataaataattattattttgtttaaaaataagacaaattatatataataaggaacagggagaaaatgaaagatgagaaaaattggatttagtaacgaaaaatacattgaattacaatcaaaacatatcaaagaacgtatcaaacaatttgataataagctttatttagaatttggtggtaaattatttgatgaccaccatgcatctcgtgttttaccaggatttgaacctgatagtaaattaaaaatgttattagaattgaaacaagatgcagaaattattattgtcattaacgccaatgacattgaaaacaataaaatgcgtggtgatttaggaatcacttatgatttagaagttttaagattgattgatgctttccaaaacattggactttatgttggaagtgttacaattacacgttttgaaaatcaagtacatgctattgcttttcaaaagaaactagaaaacttaggaattaaagtctttaggcattaccctattgcaggttatccaaatgatattgaaaaaatcgtttcagaagaaggatttggaatcaatgattacattgaaacaacaaaaccacttgttgtcgtaacagcacctggtccaggaagtggaaaaatggcgacttgtttatcacaactttatcatgaatatactcatggtattaaagcaggatatgcgaagtttgaaacattccctatttggaatattcctttaaaacatccagtcaatttagcttatgaagcagcaactgcagatttaaatgacgtcaatatgattgacccattccatttagaagcttataacgaaacaactgtcaactataatagagatgttgaaatctttccggttttagaatcaacattcaaaaaaatcatgtcaacttgtccttataaatcacctactgatatgggtgtaaatatggctggaaatgcaattattgatgatgaagcatgtaaagaagcaagtaaacaagaaattattcgtcgttattatcaaacaaaacttgattttaaacgtggtcttgttgataaatcagctatttctaaaatcgaagccatcatgctttctttagctttaaaagctacagatcgtaaatgtgtcaatcctgcattagaaatcgaagaacaaaccaatgaaccaggatttgcgattgaacttaatgatggacatattattactggtaaaacaacatctttacttggaagtgcttcagcatgtttattaaatgccttaaaatatcttgccaatattgatgatgatattttgcttattgaacctgaagttattgaacccgtatctaaactaaaaaaaggaatcttaaagaataagaatcctcgtttacatacagatgaagttttactttcattatctatttctgcaaataataatgaaaatgctaaaaaagctttatcttgtattgaacaattacaatactgcgaagctcattcatctgttatcttatctgaaactgatattgatactttaaaacgtttaggtatccgtttaacttcagaagataaattccaatttaatcgtatatatcaaaaataagccaattttggcttatttttttaatgttttaaacaataatgtaaatagttctttatttcttgtcttcttgcttctatttttaaataaatactcttttctaagtattctatttcttttacataacaatgttgatgtaaatatttaaaatcttctccttgactataaggaatagagagttcaaatacttcataatctttaaagagcagatgtgagatttcatcttctaataaatcaagacctcttttatattttgcagaaataaaaacatacggtgattgtggttgaatataagcatatttatttaaatcaattttattataaacataaatcattggtgtattttcaacccctaatgattttaaaacctcattcgttgtttctacttgtatttgatagtcttcaaaacttgtatctacaacatgtaaaaataaatctgcttctttgacttcttctaaagtagagcgaaaagcttgaattaaatgatgtggcaatctttcaataaaaccaaccgtatccgtaagcaaacaatcatgatttttcattttaatatgtcttgtggatgtttctagagtcgcaaataacatatctttttcaaagactttcttttgtttatcctggcataaagtattcaataaggtcgatttgccactatttgtatagcctactaaagcaataacaggaatttgattattctttcttctttgtctttgtacttgtctttgtttgacgatttcagcaagttcttttcgagaacgggcaagctttcttgcaatgattcttcgatcaagttcaatttgtttttcacctgaacccctaaaacctgaacctccttgttgatgagacatatgttcttgcattcccacaagacgtggtaataaatactgatcacgagcaatttctacctgtagtttagcttcttttgttttggctcgttcatcaaatatacgtaaaattaaatctgtacgatctgttacttctgtttctagaagatctgttaaattctttacttgtaatggtgtaagttcattatcaaagataaccatttcatcttgaagttttaatttaatttcttcaattttacctttaccaatatacgttgctggatttattttttctaatttttgaatcaccacatctaccacttcaatatgacacgcctcacataaagattttaattcttcttcataaaaaggatttgttgatgttaatactaagattgctttcattctttcacctctttaagtattctaccaattaggagacgctatgaaaagatataatgactattttactttactctttgtcacatttttaacacttttttctttttttcatatgtcaacaattgttgatgtcagccatgatgtcattaccattgtctttaaaaatcttctaccctctttacttccgtttatgattcttgtttcactttgtttaaatctaggtattttagatatccttgcttattttttacaaattcctttttataatttattttcattgacaccaatgatgtcctctctttattttgtttcctttttttgtggctatccaaccaatgtaaaaatcattaaagaagcttatgaattaaattatattgaccttgatgaacttcaacatcttctctccattgcttcttttagttccatctcttttatttttgtttccttaaacacaccctattctcttttaatttttatttgtcaccttctaccaagtctcatacttgccttattttatcaccatcctcaaaaaaaacttacctttaaacaagtacgacaaactctaaaacaaccacatctttcttttgtaaaagcctttaaaaaaagtgttctttccagtgtctatgctttcctctttattttaggatatatgttgattttccaattttttgtttcttttttacaagatgtttttcctcaattttcttttgattatcttaaaggaattttagaatttagtagtggctctttaaagatcattcatcagtccaaaaaaatgcttccttttgtatgtttctttctctcttttagtggtttttccgttatgatgcaagctgataatctcttagaagctattccctattcttttaaaaaatattttctttctcgtctctatcatggaattctttcttttattctttgtttactatttcttcaatttggattgatttgacagatatatggtatttatttataataatagtaaccattactattaggagatacttatgaaagaaattaagattagatactctaaacaaagagaactcattttcaacaatttaaaacatagatatgatcaccctactgcagaaatgatttatcaggacttaaaagtagattatccccatttaagcttaggaacagtatatcgtaatttaaatcaacttgttgaaacaaaacaaatcaagaaactcgatttaggagataccatggttcactatgatggcaatattcaaccacatatgcactttatgtgtaactgttgccaaacaatctatgatcttgataataatgatgaaaaaattattaaacaatttgaaaaaacgtacaagcatcatattgatgttattgatatcaatatgtcaggtatctgtgaaaaatgtttagaaaaaaaggcagcttaattgctgtcttttaattcactttagatggattataaacacttggtctttttaaagttttaactagtatatcactttgttgcttatttaaatttattgcatcaatatgataataatattgacttgctgcttgaatcccataatttccttcacctaaataagtaatatttaaatacatctctaatatttcatctttactatacattttttctaaatccctagcgataaagacctccgcaaatttacgggaaagatttttttcaaaagaaagacatagattttttgagagctgttgagtaatagtcgatccaccctctttaaaagaaaaggttgtaaggtttgtcaacatcgcacgtgctaaaccataataatctacaggaccatgttgataaaaacgtcgatcttcgctttctaatactgcttctttatatatcggtgaaatttgatcaagcgtgacataatcttctttactctttagttgatggactctttcagataaagattgttcttggattttatcttggtaaatttgatagcctaaataaccatagtacccacaaaaaccagtaataataactaataatattataatcattttaaaaagtaattttttcatagaatgctccttatgttataatctcaaagaggtgaatttatgtcttttatttataatttttttcttttatatccctattggtttataaaaacaatcatccattggattttacaattttataaaaatattttttgtttacatatcaatgaaaataaaattgatcaactttctggttttgaatttgaattactcgttcaaaaacttttgattaaaagcggttatcatgatgtaaaaatcactcaaacaagtggtgattatggaattgatattcttgcaaaaaagaagcatgttttttatggatttcaatgtaaaagatatcaaaaaaatattggtgtcagcgctattcaacaagcatatggtggtatttcttactatcatttagatcgagcaatcgttattaccaattcttattttacagaagccgcttatcaattagctgctatcaatgatattttattaattgatcgtcaaaagcttttaaaaatgcttaaaaaatccaaatttttttcaagtcagattcctttttattgttatattgttgatatcttcattattggccttttttactatatatacttacaattgcgtgatcttatttatttgagtctctgtctttttcatcttcttttacttatttatatgttttttaaaacattacgttataaaaaatataatcaaattaaagagtatacgattcatgattatcaatagctagaatcgttttttgataatgttgatagattttataacaaataaatgcactgaataaaacaataaaaacaatcgacataaaacaatgcataaaaaagttttcaggcaaaatattaataattggatctaaacgaggattaaaaagccaataatcattactaaacaccaattgatgaaacatcacaaataaacgatcaaaatcaacaaaagcaaagaagcctaaaatcaaaggaatgacaatcgttaaaatggctgtcaatttaaaaaagcgatattctttttgtttaatttgtctataaaccaaataagaagttgtaaaaaaagtaagcaaacatactatttgaatcatttcaaaaatgcgtttcacttcttcaaaatgaatacgtccaccttttgacatgataaaatctttaaaaacaagttttccttgataaaagatagattgataatgtattaagatttgataattttctttaatttgttgatatgtataatgtgtattttcaacaagttttaaatgatgaatatcaaaataataaagtggtttaaaaaagacaacaaaaacaacagaaaaagaaatgataaatagcatgaaagatatacttgtcagtatatcttttttactataagtcatataaaaattcttcacctttttgaacttctactttagaaaggtttggataatcttgttgtcttaaaacttcataaatcgtaagcgctgcacagttagataaattaagacttcttactttgtcagacattggaatacgtacacaacgatctaaattttcttttaaaatttctttaggaattccatcatgttcatgtccaaagaataaataatgttccttagaactatcactataatcttgatccgtataacaaagttttgaataacgtgtaaagaaatgatattctcctgggtttttagctttgaattcttcataagattcataaacatgtaaatctagatctttaatataatcaagtcctgctcttttcatttttttatcatctaattcaaatgacattggtttaataatatgaagtgatgtgttggttgcaacacatgttctcatgatatttccagtattttgaggaatcgctggatgtactaatacaatatggttcatttttttctccttctataattcttttaaaatcgtatataattttttgagcgctttagctcgatgtgagtacttatttttttcttctaaagtcatctctgcacttgttttttgacaaggtgggaaatagaaaattggatcatagccaaaaccattgaccccggcaatatgatcatgaatttcaccttcaaatgtttcttgaatcaagataggttcttgatctggaatacataaagctagagcacacacaaagcggcatgttctttctttaccttcaattgcatcagtgattgcttgattgataattggataaggggtatcttttcctaaaaagcgagcagaatagattcctggaagctttccaaaagcatcgatttcaatgccactatcatccgctaaaacaattttatgtaaatcatcagcaacatatttcgctttaatcaaagcattttctttaaatgtttttccatcttcaacaatatctggaacatcatcataaacatcttttaaagatttgacttcaatatttaaatcctttaacattgcttgaatttctttgacttttccttgattggttgtcgccactatgagttctttcatattttcatctctctttctttgtatgtattttagcattttttgtatcatagttcacttattttctttataatataactaggaggtttactatgattaaaagattaattgtaaatgcagatgattatggtttatctgaaggtgtttgtttgggtattttaaaagcgcatagagatggtattttaacttcaactacttgtatgatgaatatggaaaacattgaaaaatatttagaaatgacaaaagactatccaaatttaggcttaggtgttcatttgaatattacagtaggaaaacctttaacaaatgtaagttttgttgatgaaaaaggaaattttaaatcaagagatacttatacaaatagagaagctatcgtatctcaagaagagctttatcaagaatggaaagctcaaattgaaaaatttattaaaatcatgggccataaaccaacccatctagattctcatcatcatgttcatttacttaatagtaatattgatgttgcattaaagctagctcatgaatatgatttacctattcgtcaagaaacatacttacaaaaagattttgaacctgtttattttgaagaacttttctataaccaagatgctacatttgaaatgattgatacgattttacataaagatgttaaaaattatgaattaatgtgtcatcctgcgatgattgattggaaactttatcaaatatcttcttataatttaagacgcgctcatgaattagatattatatgtagccaaaaagcaaaagaaatgacaaaaaagattgaactcattaattatcaagacctaaaaaaatctagcaattagctagatttttttaggtctaatcattaaataaattggtaatccaagtaaaatacttccacctataatatttcctaaagttgaaagtaacatatgtaaccacacaccactccaagaaattcctgtaccaagagctgtaaaagtcatcgaaaatgttcccatattggcaatactatgttcaaatcctggtaaaacaaaagtcataacaataatcatcataataaatgttttagctgtttcttcctttagcttcattcctacaaatgctgctgcacaaacaatgaaattacataagattcctttaataaaaagttctaaataatcaaaatttaacttattagaaacaacacttgctagatattgattcattgcttcatgattaacaccacttttaataaataaaaaacaaatcagcgcaatgcctacaaagtttcctatataacaaatcccccacattggtataagatcaataaatcttaaccttttatgataaacaggaaacatcgtggtaaaacaatttcctgtaaacaattctgaaccaagtaaaacaataattacaagtccaattccaaaagctcctgcaaaagcaattttagatgcaattatatgatgatcaattaataacactgctaaagtataagataaaatagtagcaagtcctaaataaagccctgcaacgatacttctcataaaaaaacaaaatggatcattttttgccatctcatattttgtcattcctgctttttccaataattcaaagtccataaaatttcctccgtttcttacaataacataatttcaaaatattagaaacccctttcattgtttcttttttactttcatgttattttatatatgaggtgattatatgtttcaacatatcattcaagaattaataacaaaagcaattactcaacaaacagaaaaaatcattgaaaagaaaactaagaaacaaataaaaaaagaagaagtttatttccaaaaacctcatctttttatctctaattactatcaagcctatgcttttttattaactcttccttttttattaataattttaactctttgtatgattattcaatttaaaaataatcacttagatatggtcattatttgtgttcttttaattcttttacttatcactgttacctataaacaaaatcataaaaaattaatgattgcttattggcaagatattcttattatttataacgctaagggcactcaacttattcaaatacccgcttattacttaaaacaagctatcataaaacccaataaactcattatcccttatcatcaagaaacttgggttattcaaataaacaaacatgataatttaaaagaagttgaagaaatgcttacgtatttccaacttctttaaatcaattttcatattcatcttgctgtctaacttcatctaataaaatttgttttccacatcttttaaatttccaatattctacaaaaacaccatcataactttcaatcacttgattttgttggtctattgttacatcattcatttttccttcaatatatacccaaaaataatcttcattatcattctcactatcatataaattaactacattttgtttaagaagatgaatatgacttaattcatttctcttcccctgaaattcattccaatttatcttagcctcccaagcatcatataaattctctgtcaaatatttttttagtgtctttaaatcttgacgcccccaagcttcttgtattaaataataactcttttttacctcttctttgattcttttttcattccaaaaatcatcttgatcatctaaaatagctaattgctttttggctctttgatgaagcttattagctttatatcttctttgaaaagcatataccccataaatcgttcctatcaataaacctactgaaacaatcgaacttactggattatatgaacgacgtccataataataatgatcatgataatatgaaggtgaactactacttgaagaacttcctccacctccactacttcccgagccactgccaccaccagctctagcataacaatttcctgtaagtaaacatatcataattagaaatgttgaaatgatgattctttttttcatacgtaacctccgtttgatttattataacatatcattgacatctagaaaaagaagtataaaatatagtttgaattcaaactatataggaggcaactatgttagaagataaattttatcatcaattacttaaatgttttaatcaacaaaaaagatggattaatcaacaaacaaatcaaattgatgtcttacctgggcaaagtaagtttttactttgtttaaaagaatatggtcctttatctcctaaagaattaggtaatcattgttgtattgataaatcgacaaccactactttattaaataaaatggaaaaaatgaattatattgaaaagaaaactcaaaaccaggataaacgttctattcaaattcatttaaccaaacgaggttatgaaaaagcattacaagttgaaaaaatatctaatgaaagtgaacaattatttctatcaacactttctaaagaagatcaagtaaaaattatacaactacttaaacaaatcaatttatttatggaaggagaacttaataatggaaacacaaaataactttgcgataggaagtattcctaaacatattatgtctatagctggaccaatgattgtcgctcaactaataaatgttttatataatgttattgatcgtatttatattggacgtattcctcatgtagcgacccttgctatgggtggtctaggaatttgtttaccaattatttccattgtcatggcttttgctaatctctttggtatgggtggttcccctctttgttcaattgcgagaggtcaaggtaaaaatgatgacgctgaagaaatcatggggaattcttttgcgttgcttgtcatttttggaattattttgaccattattggttttatctttaaagaagatattttatgggcttttggtgccagtaaacataccattagttatgctttagactatctatcaatttatttaattggaacgatttttgttttagtcagtctaggaatgaatagttttattaatagtcaaggatttgcgaaagtaggaatgatgacggttcttattggcgctgttttaaatattgtattagaccctttgtttatttttgttttacatatgaatgttaaaggagctgctatagcaactgtgatttctcaaggaatttctgctttatggaccttacagtttttaacaggaaaacaaactattttaaaacttagaaaaaaatattttaaacttaatttctattatgtcaaacgtattttttcactaggaactgctggttttatgatgggtattaccaattcgattgtaactattgtttgtaattctacgctacaagcttatggtggagatctttatatcgccatcatgactattattaactccattcgtgaaattgctcaacttcctggacaaggaatggctaatgcttgtcaacctgttttaggatacaattatggagccaaagaatatgaacgtgttttatcaggaattaaatttgtaactattgtttcttttataatgatgtttgttatttggctagcaattaccctattccctgaatttttcattcaaatctttacgcataatcaaaaaataataactcatggtattacttctttacatctttatttctttggattctttatgatgacttttcaaatggtcggacaatcaactgccgttggtttagggaaatcaaaacaagccatcttcttttctatctttagaaaagtaatcattgttgcacctttaactgttatcttaccaaaatttattggcatcaatggtgtctttatcgctgaagcaatcagtaatttcattggtggtggcgcttgttatattacaatgtggttgactattggtagaaaacttcaacaaaaatgtaaggagactgtatgaatactccaaaattagaaacaaatagacttattttaagaaaatttaatgaaaatgatttaaaaagcattttatgacatcttttctgacaaggaagttaatctttatcttccttggtttcctgtaaagaatttaaaagaagcaaaagacttttatcaagaaagatacgcttctatttatcaaaaagaacaaagatatgcttacgctatttgtttaaaagaaaataatcttcctattgattatgtcaatattgatttagatgatagtcatgatttaggttatggtttaaaaaaagaatattggcatcaaggaattgttagtgaagccgttgaagctgttattcaacaagcaaaaaaggataatctttgttatttgactgcaacccatgatattaaaaatattcatagtggaaatgtcatgaaaaaggttggtatgcattattgttattcttataaggaacaatggatgcctaaaaacagacctgttatttttagaatgtatcaaataaaccttgatggaaagaacggatttatcaaaaatattggaatcaatatgaacattttattgaagaaaacatataaaggacaagttatttaaaacctgtccttttccctatataacaattaacttgttgataatattgaaggtattgttctttgaattcttgttttaaaaaaggctcttcaacatatttaatttgaagatgaaacatcatcattgcaagcaatgaaataatcaataaaattgtattaaaaaacattaaacacattcctagataaacaagatcaaaacctaaaaaggctggattacgactaatttggtaaataccatttgtaatcaaatctgttttttcttcatagctcactcctgcacgccagctatctttcattgttaaaacagaagcaataaaaacaatatctcctatgattcctaaaaatattcccatgatgcgaattatcaatggaaaagtcgttgtatttaaataaatacttagtatttctatgataaaagtagctatcgctgctcctttcatcattatttctatcttcttttgaattccttgttttccttttcccatatgatctgtttgaattccttgttttctttgttgaaacatctttataaaataacaaagataaaagacaagcaaaatcatatatcctactatttgcatcttaattccttcttctacttattaaatctataatgatcatcacgacaccatataaaacaccagctgttgcccaaataatccaactatattgtatttgtccattaccgttttcaccaaaagtataataaagaaaaatagcagtaacaacaagccaatagatggtacttatttttgattttaaagcatttttctttttttgttcaggtgtataatcccctgtttgtaaaattttatctaaagcattttgataagttcctgctaaaacaagaaaaaaacaaccaatacttacaaacaataaaagaaaacaaacagcaatactttctaaaaattcataatttaaaaagataaaaataggtaaaactgataaaatacatagagcaatgcctagaatttgataacggtgatagtgatcttgataagcttctttttctttaactgcgtattcttttacactattttcaagagaaaaatcttctttttctaaaaaatcatattttttaactttaaaagcacataaacaaaataagataactgctatcgttatacaaataattaaaaaactaagacctatacttattgttaaattttctgccatatgaaatcgttggtactgacatagcgttgtaaaaccaattaatggaataggtgaaatcacacataaaaaggttgcaaaggcaatttttaaagatgattgttttctaatctttaaatattcttgtacttgtgtcaaagataaataaattcctgtttgaatgttcccttcattttcctgatctaataatagataatctgtcgttacatgaaagagttggctaagttgaataattttatcggtatcaggcatcgattgaccggtttcccttagttaaaaatattactcttgttgattactcaactcttccaataaatcggtaatatatctcaatttcctgtattctttcgttatcctcattcgttgttgcttcatgtatgaggattttttctatcatggcatttaataatggtgctgtcagttcctttggtacggaatattccttgattaactcaatccacttttcagcacctatcatatcctgttccattttacttagttcttctcttaggcttgttatctgctgttccagttctatctgttctttttggtacttgctggacaacatcacaaaatttcgctctgttatcttctcacaggctctatcttcatacattttcgcaaataaacggtcaatctcattttgtctgttctcggctttcttcaatgtacttgcctttttcttcttttcccgtattctctctgcattgccagctttctgtatcttgttcaataccttttcttcgtcctgctgtactgccttagcccaatactgcaagcgttccaatacggcttgatacagcacatcataacgaatgtagtgcatagaacaattacctttgccaaactgcccgtagtaactgcaagcataataactgtaaggcgttttatttgtcttattcgttccaaatctcatagaccaaccacaatccgcacacttgacaagccctgcaaaaatcggcgttgccttttcctttgtctgtctgcgtcttgattttatctgctcctgcacacgatagaacacttccttgtcaataatcggctcgtgagtgttttctactcgaaaccattcactttcgtgcttacgcactttctttttgctcttgaacgataccgtagactgcatattgtgaacactgtttccgatataaacctcacttttcaatatcgccttgacatgagcaatcgtccactcataacgcttactttcgggttttccctcaaagatatgtgcaaaagtaccgtatcttgtaaaatttagccatgacgctgtcggaactttttctgctcttaactgctttgtgatttttgcacttccgtaaccttgataggctagggaaaagattttttcaataatccattttgtttcatcatcaaccaacagttttcctttgatgtcagggtgtttcttatatcctaacggagcataagcaccgtaatgagccccctccgcaaactttgtcttaaatgctgatttgactttacggcttgtatctcttgccacccattcattgatgatgttcttaaatggtgcaatctcactttcgcctttttcgctgtctacaccgtcatcaatcgctatgtagcggacattatgactagggaaatacaattctgtatattgtcctgtcataatataatttctgccaagacgggaaaggtctttcgttacaacacagttgatttttcctgcctctatatcctcaatcattctttgaaaactcggtctgtcaaaatttgttcccgaccagccgtcatcaatatattcatcaatgacattcaaatgatgttcttttgcatataaacgcaacatacttctctgtgtggtaatgctggaactttcgccctgtaattcatcatctcggcttaacctaagataaagtgcagtattgtaaatctgttgtttcattgtcagttatcctcctttataactaacccgtgtttacaatacctgcttgcaagtaaagtataacacgggtactttttgtcattcaatctatttcttacaactgcaccgattttatgcgattgtctgctttgctttttccagcatgacatcagttagaagttcttccattgttttgcccttttcggaaaaatgctcttttactacaatctttgtctttcctctgttgccaatgccacacttgccatttttcttttgaattgtttttacagcattatcaataacacataccccctttctgtaaaatctttctaagcaattcaacggcttttgtcatagcccacaggagttccacctctgcatagttcttatgtagccgtacccattgcgtgcgacgctcttaatgctcaagctgtggctgtacgggagtatcattatctgacagtacaggtcatggcgataaaagaggacaaatcttttacaagaacacaaataggttttcgctcgctcttgcaggggaaaggtcgtggcgtatttgtttcaacggctagctgtctgtcaaacgtattgaatagctttattcagttgtcaaagaacgattgaaagaaaaaaatcgtctttcctatatatcgcgttggaaaagaggagaaacgtaaccaaaatccaaaactttttccattattagtacaaatggaacggttcattttggcaatcaacggttgattttctcctttttcactactatctgtacagcaaacgtccatttgctaagtttaaatggaaaaattttaacttcttttcatgcaccatatagggatagaaaatgtcattttgctaagttgatgatgaaaaaagaatattttccttttcacaccctaactacccaaaccataccgttactgccaacaatagaatgaaatattttctttgcaccatatagggaacggaaaccttaaattgttaagttgagaacaaagtattttcatcttttcacatcaacactcaactgctaatgcctgtttgaatacaaaatgatgatgtttttcctcttttcacagaagactgtccactaatcacgaatttccgtcattttttcaaaacttttttcttctttcacttcatatagggacagcaagccccgatttaatgacctattttcaaaaaaagtttagatttccttttctcgcaccatatctgtacgcaagtagccattttgttgcagatttaataaaaaatttatttttcttctttcacttcacatagggaatgaaaacagctctttgctgactaaatctgaaatttttcaattacattaaaaaataccgtcattctcttgtggaacagcggtatctatacgttcttctatggttgatttctctaattgtaataaatgtttatgcttgtcttttagttctgcctgctcaatcatatctttcagtatcgttgtacgattttctctgtctaatgcctgtaccatttttatggttggtgcgacttgtctttgtagccaatgcaacgctttttgtaaagtgtaaggctctggctttgtggttaagcgtatcggctctctgttttcccctacaaaccatgcccaatcatcatttgttatccattgactttttggcttgtcgtcctctctgtcaacaaagcggacataatgattgatgatagaaaaagcggtgcgttcagcgtcccgataggtcagtaaatctacaaccgcataataggctcgttcgttcttcatgcgtatttcaaaacggttcttaatctccgtatcttcaatttctgtgccattcttgacatactgctcataatttttctgataagcacacatatataattcgctacttgttgaaccgagatataaggtttctcctgtattctttggtaaatcgctaccgcatttttctgtaccgctgtaatctttctgcatacggaagtaggacatacattcgccagccttgtatttttcctttaactttggaatatccaatattcctgctttatcattgatagccaaatcaagccgtttcatcacaccaccagccgtcatacaatccagcatgaagtcataccatgagcgttcctgtgccagcagataacattccatttgccgacagcctttgcctttcagttccaataaaacacctaaatgctcctgcatggaacacatgatattgatgtcgccaagtacatatttgctttcatatccgtattttccataatcttcataaagcatgtaattagatttcagttgtaatacatcacggataatcgccaatgcgtccgtagtaggaaagcggacacgaaagtaatcaatcaataagaatagtggttcttgcggattgaaacgctcaatctgtttttctatgatttctcttaattcgtcattcaatggctgttttcctttttcaatgcggttgtaatattcacggctgataccacaggcaacagcaagccttgtttgtgttactccgtattcctcacgcttttgtcttagttcttcaataaagtttttatcattcattcttcaattcctccaatcaaaaaaggcaactaccataattgataattgcctgtcattaaaaatctgtatagaaaaagcagtcaatcctaagactaactgctttgtgtgtatggatataaaattgcttctaatcttgaataggtatccaaatttcaataactgaattatcactattccaatgaaaacgataatcgtatttttcaaagtgtaggataatatcttttataggaatatacgatgtactaggaataatttcttcataaatcttgccataagtttcatatattttatccatagcaccaatatgctccacaaccaaatatttataagacggtatttctttatacagaaagccctctggggtaatggttctttggggaatagaacagaaataataaagttttccatttcttctttccataaaagcatattttacccaatttcctgattgtgaaagatacgcttttttcaaactactgttaaactttctccaaaactgtgtactaatctgaatattctttttttgataattagtcagttctacttcctgcccaataactgcaaatgcgtttaattcctttatagaaaaatttatcattttaccttgtgagcagtgataacggtataactgtacgcatttaccgttataatacaattatcaatcgttatataccagttttttccttttcttgtgatttccgcattagaaaggctaattttttctttgcaccattcaattacattttctacattcaaagataagttctttttaattctaataacgccaagttcagttgtgtgaagtcttcctaagttttccagtaattcattttccatattttgatacctcatttttcagcaaatttatttgtatgttttataccccaattataacattctcatatcagcactacaataaaaataattaagcaccaataatcttattgaacatctccaaccgtaaatctttcacaccatcagtgataaacactgagctgacagcaattacgacaactaccataattgcctgcacttaaatttctgcaaaagaaaacgacaatcaatttcttattttttgaaatcaactgtctttctcatatttactattcaattttcatagtgatataggtacaatttatatcactactgtaaaaatggggttttgccttataaatacagcgttttccgcttgttagtgtatagtgtttcttgttttttgtgccccccttgttagataacgggggctttgaacggctcgcaagctcgccgaaccgccgaagcgaaccgcccccttgcaagcatggcggaaaaatcttaaggattttcccgccaacgtggtcggatcgctccgtcggtttaacagcttttctgtttctctctagttatctacgcatataaatcaaatcggttattccgttataagtctgtgttttacaaagccttaactttatttccctgtctatgttgcccaaaagacgaaccccatttcctaacagagtaggaataacagaaatgtaatatttatcaatcatatttttgcttaccaactgctgaacaagatttgctccgccacaaatccaaatatcctttcctgcttcttgttttagccgttccaataataaaacaggattttcacttgtaaaatgaatttgttgggaagaattgcactctttatgtgttaatacataagttgtaaatttattatatacccattcttgcggagaaagttcagtaacaacctgatgagaagtattccaccccattaagacagtatctatatctttggtaaattctgtataagtgtcgatgttttcattgtcatttccatgaccatttagccaagctactccaccattaccgtccgcaatatatccgtcaaggctcatggcaataaataaaactacttttctcattttttctcttttataaatacaaacaggaatttatttctcttttttactcataagggaacaactgattgctacaaataaacccattaaaatccatggaaatgctgctcttataaaatcactaaccatactttattcctccttaaattccaatttccttagttctacaaactgaaatttttgcctatgaatgtatcttgttctttatacgcaaacaggcttctgtgtgcataatccaatgtcttgaaaacggcatttgaattagtccacaaatatctttattacaccaataatcaatcagccaaattgctttttcattgtcgtttactacattcaacgattctaagtatccttttctttctttcggtatttttcttttcaattcatcataagataaccgttcaagcattttctcagtgctttcccatacttcgaaaatatataaatataattcttccagattaagctgttttgaaaagtctgcaatctgctgtttcatgagttcatttcctgttgtaatgataggtgaattgatacgctcttgataattgcctgcaaaaaatacttgttcatcttcatttatcactgtatgcacaactatatcttcaatgcggaaaatatgccaaatagaataagcaatcgtcttactatgataaccatcagcgtttatgaaggggattgagttaaaatcttctctgcataattcttctttgaaagatactaaggtttgtattaactgacttcgtaaagtaagtaaagtatcaatacccctcttataagtatctttcttttttatttgtgcctgcattgttttattaagttcagaccattccttattcatattcaatcctctctcaaattctgattttatcgccccatacaaactggaatttgtcttacaacaatttatatatgcataaaaagcaatatatttatgaaaacaccctaaatccaaaatttactcaattcattttttccttacataaaatgttctcgtatatttcacttcctcaccaagtgtttcccctatcaaaacttcaaaatcattgatatcaaattctggaaagaatgtatctccatcttcaatatttaaatctacttctgtgatatacattttatctactatttgcaaagcttccttaaatagtccatatccaccagatatgtatacatctcgtcctttagccaataataatgcatcttctaatgatttaactgaaactaaattatctccttgatactctgttgtggtggaaacaacaatattcattctattaggcaacggatgaccgatttcttcataagactttcgccccataataaccacattacccgttgttaactctctaaattgcttttgttctccctttattttccatggtatattaccattcttgcctataacattattctttgacctcgcaacaatcaaacctatcatctatttcatcctccataatatgatgtcgtacctgtgattccatcaagtgcaccacatcttaacaaactcaaaattatctcgaactaaccagctcgacaaattccttttttgtcttcatctgcattatatcatattgttataagcattgccatttcttttctgcttttgaaaagttacttatcagcctatgttttgtaaagggtgatattcagcatttctcacgcaacaagcccttgacaaaccatagactaataagttttaaggtaatcaagcagaaatgaaatagtctgctgtttcacggcaacaaaaaagagataccaacacacttatgtagtatctcttagtctagtagcaatattcttttgtttgcaagcaggtaaacatgggctgtttcttaatatctttttgtttgggaaacacctgactcccattttgaaacagcttgtcttgagatttgaagatggttagccaattcttcttgtgaccacccttctttttttcttaacatcattattttttctgataaattcataacttccctcctgtttctatcttagaacaattattcaaaaagtactaccaactctacttttcgttttgtcaactatcagttgacatttagatatttgttttaaaaaagcttataattcctacaacaattaataaaacaaaggcaaaataaagcaaaccacatgagaccatcaccattaaagtaatcggcaataaaataatcgttaaaacaaattttgaaagtccccaagctgcctttaagccaaagaaaaataattttccaaaaatgtaaaacatcaaaatcataaataaaaaatagaacattttaatctcctcttatcctaaaaaaacatccattaacatcatgattacaaaaccactcaaaacaccaaaagttccgacatgactatgtttaccaagttgtgcttctggaattaattcttctactacaacatacatcatcgctcctgcagcaaaagataaacaaataggtaatattgtttgcataatatgaattgtaaaaccagcaataactcctgcaatgggttcaacaatccctgaaagacttccataaacaaaagcctttgtacgtgacattccttcctgttttaaaggaagagaaatagctgctccttcaggtaagttttgaagtccaattccaagagctaaagcaagtgcagaagcaaatgtaatacttgaattacttgcagcaatcgcaaaagtcaaacctaccgcaaatccttcaggaatattatgtaaagtgactgctaaaacaagcatcgtatttttccccaacatacttttaggtccttcaggcttgtcttcatttaagtgttgatgaggaatcacatgatctaaaaaaagcaagaataaagctccaatgataaatcctccacctaaaataagggcactattttgaccattggcttccgccatttccatggaaggaatcaataaagaccaaacagaggccgcaatcataattcctgccgcaaatcctaaaaaaagttgttgataaaaatctttgatttcatctttaaagaaaaaaaccaacgcacttcctaaagtagtcattaaaaatgtaaataaggttccaagtaatggataaagtattgtattcataaatcccccttcttcttttattataaagattttgaatattttgcataatgatatgctaaaataattatgtttttgttataataaggacaaatggaggaattttatgaaagatggatatataagagttgccagtgcatcaattgatacacttattggcaatgttaaacataatgctaacgaaattaaaaagatcttaaaagaaacaagagaaaagaaagcacaagtggttgtttttcctgaacttgttttaagtggttatactttagaagatttatttttacaaaatcgtcttttaaatgaatgtcttgttcaattagaagaaattatgcatgatacaaaaggacaccaacaaattgtcgttattggtttaccttttcattatcaaaataatttatataatgtatctgctgttttatatgatggaaatattttaggaattgttcctaaatatcatattccaaattataatgaatattacgaaggcagacgttttacaccttgttttgaagataatattgaaattgagctttttggacaaattgttttatttggtcgtaaagtagtttttgcttgtcaaaatttaccaagttttacattaggtgtagaaatttgtgaagatttatggcttccaaatgcgccaagtaatgaacttgctttaaatggagcaacggtcatttgcaatacatctgccagcaatgaattaactgctaaaaaagattatcgaagaaaccttgtttcaatgcaatcagcaaaacttgtttcaggatatgtttatagtaatgcaggaagtggagaaagtacaaccgatgtcgttttctctgggcatcatttaatttgtgaaaatggaacgattattaatgaaagtactggttttgatgctgaagtgatttatggtgatttagatgttgaaaaacttattagtgaaagaagaaagatgacaacttatcaatctcatcatgattatgactatgtttactttgatatggatttgattgatattgaaacaaatcattactatgatcctcatccttttgttccaagtaatcctgcacttcgtgaattacgttgtaaagaagtctttgaaattcaaacaagaggtttaatgcaaagattaaaagctactcatataaataaagtcgtaattggtatttcaggtggcttagattcaacacttgcactccttgtttgtgtcatggcatttgaaaaattaggttatgataaaaagaatatttatgcaattaccatgccttgttttggaacaacatcacgtacaaaaaacaacgctttaggtctcatggaagaacttggagtgacaagtcaaactgtcaatattgctgatgttgtaagaatgcaatttaaaaatattgatcaagatgaaaatgtacatgatgttacttatgaaaatgttcaagcccgtgaacgtactgaaatcttaatgaataaagcaaatcaaattggtggacttgtcattggaacaggtgatttaagcgaagttgctttaggttggtcaacttataatggtgatcatatgtccatgtacgctgtcaatgtttcagttcctaaaacacttgtacgctatcttgtagactatgtttcttctctttataaaggtcaagttcttgaaacaattttacaagatgttttagatacacctgtatctcctgaacttcttcctcaagaagatgataaaattgttcaaaaaacagaagatatcgttggtccttatgaactccatgatttctttatttatcatatggtacgttttggtgatgaacctcgtaaactttataaaaagacaaaacttgccttcaaagataaatatgataaagatacaattaaaaaatggttacgtttattctactggcgtttctttagtcaacaatttaaacgtagttgtatccccgatggtccaaaagttggatctgtcgctttatcacctcgtggtgattggcgtatgccaagtgatgccaatgttcaaatatggcttgatgaagtcgaaagaatttagaactgcttgcagttctttttttattaactccttattttatccttttaataagagttttcactaaatatttaaatccatctatgataaaataaagcaagaggtgacattatgcatatttataactcaaatcactatagttcaacaatgaaacaaatcataaatgattgtttacactctgcaaaagaaaatccttttgctattcattacgtcattgttgacgatcctaaatattacgaagaaattttcttaaaacatacagataccatttttaatattgaactcatgacattatcgtcgttttatcaaaagcttctacaaatatatcatcaagattttagaaaaaaaacagatattcaaaatcttttagaaattattaaaatgaataaagaagatacctcttctttatttcatttaagcgctaatcatgttttaacagctaaacaaatattagatatttttaaaaatttctatctttataatattcaagaaacaacaaaagagttaccaaatttatcaaaagaaaaaattaaaacacttttcaatttatatcatcaatttgatcaaactcattttttagaacatgatcttatttattcacttattgatgaaaagtgccacaattattattattttctaacaaatcaattaacaatttctaaaaatcaagcacttattcaaaagcttgatcaatatggtcatgtttttatttatcaagatacaaaagaaaatgaaattcttgattatacaggttacgtcacaaatcatttatttgattcatcacatacaaaaagtgactttgaacatccttatcaaatcttaaaagcatcaacgattcaagaagaagtcaaacaaattatttttgatattaatacattacttaaagaaaatactttacgtgattttgtgatttattacccaaatgatgattattatcgtcatctttgtcgtattttagatcaatttaaccttgcatataatcgaaaagaaacaatcactaatcaagcttttcaagtcgttaatatgcttttacaatattgcctaagtaaagatgaaacatatcttttagatgcaatcagttctttatatttattaaattttcaagatcatcaatatgtatcttatttaaaaaatttatatactttacaaggttttattgatgatgaaaattatctagcattaaaaaaagcagttttaaatattcaaggtcatgatttatcatcctattctttatctttgattgattttattgaacactctttttgtaaaaatgaacttgtttatgctttactttcaagtttaaaacttgaaggaactgaacctctttctttaaaagaatatttaagtttacttcaagaaatgttttctaaaaaaacacattctcttaaggaaagctatgacagtctttatttacttaattacaatcaaccttacagtgaactcttacaagcaaaatatgtttattgtttaggtttaaatgaaacaattattcctcaagaatttaaaaataccaatttacttttaaatcaagaagcacttgcattaaagtatcctacaacctatgatgcactaaataaacatcaaaatactttaagacaccttttttcttgtcatcatcaaaaaatcattttaagttatgcattaagagatttaaatggtggagatttggttgtttcatcgattattcaaaaattaacgaaattatttacgataccaacttttaaaaaacatatacttattcatccttcattaaaagaagattattatttaaaaggacatcaagatgattcattatctgttttaaatcatcatctattggtttacaaacaatcccatcatcaagtattaccaatgcatatcaatcatcaacataatcctctttccgcaagtaaattagaggtctataaccaatgcccttataaatactatctacaatatatattaaaagtagattctataaataattctttaatacaaagtaatgaaatcggtactttagttcattatgttttagaaaaaaatcatcattatttcaataactatcaagctaaaaactttgattccttaaaagaagatattcatttaagtattcaaaactatttaaagactcatatgttaaagaaatatgctttgaaaaaaaatcaattctttttaaaactgattgaagatgatttatataatacaattattgttctagcaaaacagatgcaacatggtttatttgaactctctgcttgtgaagaaagagtttatgataagatccaagatattgaacttaaaggttttattgatcgtgtagatttatatcaaaattatttaaaagtcattgattataaatcttcgaataaagaattgaatttagaactagcacgtttaggatttaatatgcaaatgttgatttatttagaaatgttatcaaagaataaaaactatgataaaggcgctgttttgtattttaatacaaagaaaaggatattaaaaagtgagatttctattttagaaaaacaagatcctgaaaatttttttaaactttataaaatggacggctatagtgtagatgacacttatttagaaattgatcatgaaatagaacaagaaagtgatattatcaagatcaaacttaaaaaagatggtagtccttatagtaacgctaaaattatttctcatgatgaattagatacccttttacaagaaatcactttacacattcaaagtctttaccaacaaatgattactggagatattcgtatttatccaacacgtagtgataatccaaacattgatatgcatattaatccttgtcgtttttgtcattataaagccatttgtaattatgatattttttataatgaagatcatcaaattgaattaggaggtcaaaatgaagaaagataaaagtttaaatgatgaacaaaatctcgctgtttatagtcgtggaagttctattctagtttcagcacctgctggttctggaaaaacaaaaattcttgttaatcgtatgatgtctttaattgaagatgatcatgtaagtgtagattctttacttgttttaacttttacaaaagcagctgctttagaaatgaaacaaagactcgtagaaagtttaaataaaagaattcatgttgttgatgattctttaaaagtacatttagaaaaacaaaagatattattaaatgatgcttatattacaaatttccattctttttgtagtgatttattaagtcaatatggctatacaattcatttggattctaaatttgaaattcttgaaaatcctactttaattaaagaaaatattttaaatcaatgtcttgaaaaatgggttcaagaaaaagaattttatgatttttatcaagaaaattatactggttatcaatttaattcttttaaagaaattctttttcaattagataatttatcacatactgtatatcattttgatgattatttagatcaagtgaaaataaaactttatgatcgtgtcatcaacgatcaaacaattgaagatacgccttttgaaaaaccattaaaaaaattattacacgaagcttttcaagaagcctatgatagttatttaaagcttgaagattattgtcaaacatatggtttaggtttttactttgaagaaacaaagaaattacctgcaccacatactgttttagaaaattattttcaaaatttaaaagaatgtattaatcaaggaaaatatttttcaatgggtatagaaattgaaaaacatcgtgcggctagttataaagatgttgatgattcaatcaaagaaacatataaatccttattagatcaaactaaaaacacttttagtaaagcttatcaaaaatgtatgccttcttcgattgaagaattaagtgaggttttaaaagtttcttatcgccatttagaaatctatttaaaatatcttaaagaatttcaaaaaaaataccaagcttataaaaaatctctttcttatttagattttaatgaccttgaacaatatacccttcaattattaagtgaaaatcaaggagttgctcaaactctttatcaacaatttcatgaaattatgattgacgaataccaagatacaaatgaaattcaagaaaatttgattttattaatttctcgttttcaagaacctgaaattaatcgttttatggttggggatatgaaacaatcgatttatcgttttagaaaagcagatttagatatttttaatgaaaaatatctcacttatggtcttgaagataataatcaaagaatcgatttaaaattcaattatcgttcaaataaaattgttttagatagtattaactatatctttaatgcgattatggatcgtcgttatggtggtttggaatacgacaatgatcctcatgcccaactaaattacgactttttacgaaaagaaaaatgtgatactgatgaaaaattacaaaaagccatgttacgttacgatcaagaaaaacgtttcgatagtgaaatcatgctggttttaaaacccgaagatgaaacagtggatatgattgaatatgaagcaaaaatgattggtaaaaaaattcatgagatggttggtcatcttgaacttgatttttatactggaaatcgtttagcaaagtatcaagatgttgttgttttgatgagaaatgttgctaattttataacttataaaaaggtctttgatgctatttctattcctaatttaattgttcttactaaaggattttttgaaagtaatgaaattttagattgtgtttactttttaaaagcattagataattgtttagatgatttggcacttatttcattgcttaaaggaaattataaaaaaacacgctttgatgaaaactggctttaccttcataaaatagaaaatacatctatatatgaatctttaaaacaagcagccgatcaagaagcgattgattttttaaactattatcatgaaatgcaagaatttgctagaaatcatccagtatatgaagttttagaaaaatttattaaagaaaacgaatatgatctatttatcagttctctatataatggtaaacaacgctatgccaatgttcaacttttaattgaaatgttgaaagcagatgaaggtctttctttatatcaaatcgttcataaatttgaacaaacaatgactttaggaattgattataaacctgctactctttcaagtgatggtgatgctgttacttttatgacgatccatcaatcaaagggacttgaatttcctatcgtaatcgttaatcaaatgaaccatcaatttaatttttctgatggaaaagcacctttaattcaagataaaaatttaggaatcattttaaatcctcatcaaaaacaagatttaggtgattttcaaaatgtccttattgaatatccacatcctttacgtggtatcttttcaacagttcttgataatgaaaccattaatgaagaaatgcgtattctttatgtagctcttacaagagcatctcaaaagttggttttaacgggtggtttaaaagagattaatatgattgaaaaatggcaaaaacaagtcattgattacgcgctggatgcttcatgtcatcttttacctgcaacgattcgtaaatcaaatcaaatgttgaattggatcatgcttgctttaatacgtcatcctgattttattcaacaatgtattgatttatcattatttgatgaaaaaattaaaaattattatgatttggatcaagtaaaaaataacgctttacaattaaaactttatcaagaaaacaagatgcaacttaatacatgtcattctaaatttcatacatcaattattgatgttcatacaattgatgaatatatctatccaacaagtcaaatagaaaataatgatcgagaactttatttaaaaaatagtcaatttaattatcaaaacaaagcaccttttgataaaacagtagcagttacttctattattgatgatggaaatcgtttttttgaaagagatgatggagaaaatgaatcatcaatgaaagcaactgatcgaggaactcttgttcatttatttttagaattgtatcctttagataaagaattaaattttgaagagtgttttcaaaatattatacaaagatctttatttaatgaagaagcgagaactcttttaaatcaatataaggttcatttagaaagctttattgaaagtgatgtttatcaattgatgttaaaaagttcatattgttataaagaaaaagaattttcatttttaaatgaaaataaacaaattattcatggtatttttgacgttttatgtattaacgaagataaaataacaatcattgattataagacagatacattagctaaaaatagttctgatgaactcttaaaagaacttcatcaaggtcaaatgtattattataaaaagattatgaagcaaatgtttccaaataaagaagtggaagctattgtttattatttacacattcatcgttatgttacactttaggaggtttctatgaaaatattaattgcaagtgattcttataaaggaagtttatcttctttagaagtatctaaaagtattcaaaaaggatttaaagaagtttttgaagatgtttcttttaaaacgctatcaatggctgatggaggagaaggaacaacacaagctattgttgaatccttaaatggtcaatatataacaattgactgtcataatgccttacaagagcttattcaagcaagctatggtatcactagtcaaggagctattattgaaatggcaagtgcttctggactgcctcttgttaaagaaaagaaaattagagaagcaaatacaaaaggaactggtgaacttattaaagatgcactagatcgtcattgtcaaaaaatctatcttggaattggcggttcagctaccaatgatggtgggattggaatggctcatcatttaggaattcgttttttagataaaaatcaccaagttttagaacctattcctgaaaacttacctttcattgaagatattgatactcatcaacttgattctcgaataaaagatacacaaatcatcgtcatgtgtgatgtaacaaatccactttgtggtaaaacaggtgccagtactatctatggccctcaaaaaggagctaatgaaaaggatattcaatttttagatcaaggattaaaacatcttgtagaaatatgtgttaaaaaaggctatcaagattatagtgaagaagctggttctggagctgctggtggtttgggatttggtttaatgacgtttttaaatgctaaactacaaagtggaattgaaactgttttagatgttgttcattttgatgaatacgtcaaagattgtgatcttgttattagcggtgaaggacgtattgatcatcaatcaatgtatggaaaagtacctactggagtgagtcaaagagcaaaaaaatatggtgttgacacagtttgtattgttggctctattggagaaaatgttggtgatatttataattgtattacaacgattgaaagttgtatcgatcattgttgtcctttagaagaagctttagaaaatgcaggtgaaaatgtttataaagctgcttttaggcttgcaagaagtatccaattaggacaaaagatgcgtcactaaacgcatcttttttgtttcataaaattccaaaaagcaactccaatgataattatataaccgattacactataaacatcaggtacttgatttaataagaaaaatccaagtagagctgcaaaaataacttgtgtataatcataaatcgatatttctttagcaggtgcatatgtataagcattcgtaattgaaaattgtcctcctgttgccattaatcctgccatgagtaaacaaccaatttgttgaagtgtcataggttgaaaatgaaaaattaaataaggtacaacagataaacatgaaaataatgagaaaaagaaaacaatttttgctccagcaacaccttgttgtcctaattttctaacacaggtataagcaatccctgctcccatcgctcctaaaactccaataaacgaattgatattacttacaaaatgaatagaaggtttaattacaaataaacttcctataaaagcaatcataactgttactttttgaatcgtatttgctttttcttttaaaaataatgaagaaaagataataacgaaaaatggtgataacttattaagcatagatgcatcacttactaataaatgatctactgcataaaaattacataagatacctaacgttccaaaagtagaacgtaaaagcaacatcggtatatccttcttttgataggtaaaaccttctttacttttaattagaataataaatgcaaaaagtgctgcaattaaattacgaaaaaaacttttttgaatagatgataaatcacctgataacttaacaaaaacattcatacttgcaaaaaagaatgctgccattataataaataacattcccttttttgtatcgttcataaaatacccccttaaaacaaaagaataaggacactgtccttattcagtaattttaacaacttgatgtgcttgaagaccacgatctccttcaactaattcaaactcaaccttttgtccaggatcaattgttttaaatccttcttgaacaagttgtgaatagtggaagaaaatatctctttcttcaccttccatgttgataaatccaaaacctttatctttgttaaaattctttacaataccaatagccatgaacacttcttctccttcttttttatctacttaatattctacatcatattgcttatctagacaactacattattctaaaattaaaacatttttcaccaattttttttctacaagttcttctattaaatctgttggtgaaataatacgatatttaaaaacttgtgtttgtttagaaagagtgatattcattttttttaatgaacaaaccaccagctcactacaatataattcttgatcacttgataaatccatttgataatcataaggataatttaaataatctaaagcatttttcaaaaaatctttaataaaagtattctcttttaaaaaacgaaaacatgtcatggcttttaaataagactcattttttaaattagccatttgatcaaaggtacgtatctgtacacctccaacatttgcatctaaaacaagtatttccttttgcgttttatacatcttcacgattttttcataatatggaaaagaagtatccaaaagttcttgaacttgttttaaacttcctaaatagataagtgtatgtttccacctaccaggaatcgcaatatttgaaatataatgactattttcaatattaataatatccccacattgcaactttgaaaaattttctgaaacctcttcataactaaaattttccttttgagttgatacctcgatatcttttttttgagtacatcccacaagacataaacataatatcaaagcatatattctatacacatcatcacctagatcatacttaaacttactctttttttatttaaatcaacatctatgacattgacttctacaatatcccctatacttaaaacatctaatggatgtttaattctttgttttgacatttttgatatatgcactaaaccatcattttttaagccaatatccacaaaagctccaaaatcaacaacatttctaacagttccttctaaaaccattcctggttttaggtcttctatatgaagaatatctttttttaaaagtggtgtttgatattgatctctaattgaacgatttggtttaattaaacaatcaataatatcatctaatgtatattggtcaatttttaaagtttctataacttcttttttattaatttttaataatttatctttaagtttcactgttcctaaatcagctaatgataattgacataaatttaataaatctaaagcttgttgataattttcaggatgaatagcagtagcatctaatggaagatcaccatctaagatacgtaaaaaacctattgcttgtgtatacgttttggctcctaatttttttacattttttatttcatttcgattatgaaatttaccatgttcatttcgatataaaacaatttgttgtgctacaccagcatttaatcctgcaacatatttaagtaatgacttagaagctgtattaatatcaacacctacattatttactgttttttcaacaacgaaatccaattgttcttctaaatctttttcaggaatatcatgttgatattgtccaactgaaattgctttgggttcaattttaacaagttcagcaagtggatcttgtaaacgtcttgcaattgatactgcagatctttcttctacatgataatctggaaattcttctttagcaatttgactcgctgaataaacagaagcacctgcttcagaaataatagcaaattctacattcaaatgatgttcttgaataagtttggcaataaaggcttctgattctcttgaagcagttccatttccaatagcaataatttcaattttatattttaaaataatatctaataaagttttaatatctttatcataattatctttaggtaaagtaataaagactttatcaatgtgtaagactttacccgtttgatcaacaactgctaatttacatcctgttcgataagcaggatcaacacctaagaccattttattttttaatggtgcttgtaataaaagattttctaaattgactgaaaagacttttaatgcttgttcattagctttttctgttaattcttttcttatttctctttcaatagaagggaataataatctttgataactgtcttctactgctttttgaatatatggtaaaagatttgtttctctgttttttgtaacacctcttgtaatgtattgtaaataataatctttatctccttctatatttacattgattactttttctttttcagctcgattgattgctaaaatacgatgtgatactaaagtttttactttttcttgatagttataatacatttcataaactttattttcatcatcatgttttttcttttcacttgtttttaaaataccacctttatatagcatatcttttaaaaacttacgatatttaatatcatcagcaatatcttcagcaataatatctaaagctccttgaatggcatcttctacatttaaaacatcatcatttaaatattttttagcttctactaaaatatctcctttatttaaagctaagatccatttagctaaaggttctaatccttttgctttagcggctgttgcttttgtttttcttttttctttataaggacgataaagatcttcaacttcgcttaattgtgtagcttttaaaatatctgtttttaatttttcatttaacattcctttttcatcaattaaacgaataacatcttcttttctttttaataaattcacttgatattgataatatttatcaattgtacgtatttgatcttcatctaaagcacccgtcttttcttttcgataacgtgctataaaaggaactgtattaccttcttctaataaagataacactgcttcaatttgatgtactcttacatttaattcttcactaattgttttaataatttcttgattcatataaacctctttaaatacttgtatattcttttaacgtatagataatatcttggtaaatttcatcacataaataatcttttaattcatcaattgaacaccatttataatccgtatgttcaaaagaaatagaaacatgatcatcatctgtagatgctaaataaccaatacctactgtttgataatcctttcttattttggtaaaagtatatgctggtttaacaacatcgatcgttaaacccgtttcttctttcaattctctttttaaagcttcattcggtgtttccccatattctaaaccgcccccaggaagctcccaatatcctagtccatcactagatggtctaactcttttcattaataatactttttgtttaaaaacaacaattccttttactgtaatatgaaatcttatattttccattgatatttccccctatactgtctttatcataacattattttatcaaatgtgtttaaaaattattatgaaaaatgtataatatatgtcgaggtgattttaatatgattaactttaaagaagaagtcgaaaaaagaaaggaacagcttattcaagatattgaaacattatgtgcaatcccttccgtttataatgaaaaaacaatcggtgaaaaccaaccttatggaagtgaatgtagacaagctcttgatgctatgttagcaattggaaaaagagatggttttgttgtacatgatgaaaatggttatgctggacatatagatattggtgatcaagaagaaagttttggtattttaggtcatttggatgttgttcctgttgattcaagaggatgggacagcgatccatttaaagtggttcaagctaatggtaaactttatggtagaggtgttgctgatgataaaggacctttacttgctggatattatgctgctaaaatcattcatgatttagatttacctgttaaaaagaaaattcgtgttatttttggttgtgatgaagaacgtggatcttcttgcgttgaacattactttactaagaatccatatccatctatgggatttactcctgatgctgaattccctgttgtttatggtgaaaaaggaattgttcgtttccatataacaggaaatgtaaaaaaagatggattgattgcaatggtagctggtgatcgtgtaaatattgttcctggtgaatgtgaagcaattatcgaagggaatcataaacaatatgaagaatcatttaaacaatttttaagtgatcatcatgtaactggtatcattgaagaagaaggaaattgtacaaagcttgtcttaaaaggaaaaagcgcacatgcttctttaccagaagaaggaattaatgctgtaagtttacttgcaacttatttagatactgttattaataataaacttgtacattttattgcaacgtatttaaatgattattatggaaaaggtttacaaattaatcatgaaggattaatgggtaaattaacaatgaatttaggtgttgtcaaatatgttaaagaagatgctgatattgaattagacttacgttgtcctcatgaaattgatttaaagaaaatgtgtgatagtgtaaaagaattatgtcagtctcttggattaaatttagaaagtgatattcatgaaccactttatatagatccaaacagtgaacttgttcaaaaacttcataaagcttatgttgaagtttcagatgatacagaaagtcagccacaagcaattgggggaggaacttatgctaaatcaatgccaaattgtgtagcttttggatgtgaattcaaagatgaagataacgcaattcatggtaacaatgaaaacataaagattgactcattattaaaatcaacagaaatctttgctaaagcaatttatgatttaattaaagaatagaaatttctattctttttttatacaaaaaaacttatctttaaagataagcttatcaactctatggtgcggccgaccggacttgaaccggcacgacataagccataggtccctcaaacctacgtgtataccaatttcaccacgaccgcatctaacatatttaatttaccacattttgaagataaaaacaagacgactatttgttagtcgtcttcatttttaataaatcatctaagttatatggtgtattttgatatacataatagttaagccaatttgaaaataataaataggcatgactacgccacttaactaagatttcatcattgacatcatcatttttataatagtttttaggcattacacaatccccacctttagctaaatcacgatgatattccttatctaatgtatctggatcatattctggatgtcctgtaacaaaaaatcttgacccgtccttttctgctaccaaataaacacccgcatcgtttgaagaagctaaaatatctaatgaatcaattttttcaatatcttcttttttaacagaagtatatcttgaatggggtgcataaaattgataatcaaaacctcttagaattcttcttctcatcttttctggatttgtatgatgatgataaacacctgttaatttttctttcaattgatatttttcaacaccataataataatataaagatgcttgagaagcccaacaaataaagaatgaagaaaagacatttgtattggcccaatcaaaaatctttgtaagttcatcccaataatctacatcctcaaattttaatttttcaacaggagcacctgttacaattaaaccatcatacttattatctttaatttcattaaaggttttataaaattccattaaatgttcttgtggtgtatttttagaattatgactttccatacataaccaatctacttcaatttgtaaaggtgtattagaaagcaatcttaatagctgtgtttctgtcacgattttagttggcataatattaacaataattaattttaatggacgaattctttgtgataaagctcttgtttcatccataacaaagatattttcttcttttaatattttacttgctggtaaatcatttggtatttttattggcatatgtaacttcctctctatgaaaatgaaataaattcattgaatatttttaatatataagcatctgacattcctgataaataatctataatacttttagccattgtatttttatcgtgttcaaaatcataaataatatgattttgatataatggatttctattaaaatacttcatttgactatacttttctaaccaatgcatatatccttgaatagttacaggatattttttttgatctttctttaaagcttctaaaacatttatttgtttatcatttgctatcttatcatatttatataaaaattgaaaaatagaatttaaaataagttgtacataatttgtgtggacttctatacgatcaattagataaatattttgataattgaatttcataatatacttcatgacttcaaaagcttcatctgataagcatattcctttctctatagaagaattttgacaaacatctaatataaaataattaacaattgttccattattaatagcatcaaaatgagagtttgttaattgatttagatgatttcttaaatcttctacaagctgttcatcaataatatttaatcgtaaagcatcttcaatatccctagcaagataagcaattttatctgacattttaacaacacagccttcccaagtataaggattgtattgcccaggatataaataatcctttaaatcaatagattcattccttttaataattgctttttgattcatttctccacaatgagaaataattccatctcttacagcatacgttaaatttaaatttctacgaacatgatgatcatcttccaaagtttcaatttgatctacaaaatataaactatttttttcatgccaaaaatcttgtagaccatgttctttagaaatctgattaatgatcttttctccaccatgtccaaaaggtgcatgtcctaaatcatgtccaacagcaattgctcttgtaagttctgtatttaatcctaaataatgagcaatggtataacttactgaatctacaagatttacatgctcacttcttgtacaaacatgatcatcttcaactgcaaaaaaaacttgtgtcttatgtttcaatctacgataagcaagagaaaaaataatacgattataatctctagaaaaaggacttcttaaatcattttttctttgataaagtgcttcatttcttgaaattgcttgttgatattgaggatgattttcatacattgcttcttttaaaaaactattttttgacattttttatacctcgcttttttattatataaaaattaaaaaaaaagataaagaaaaagattatctttcgataatcttttagaattttaagaatcttctcattgaaacaaaacttccaattaaacctactccagcacctaagccagctaaaataaatgagaaatctctaataaatggcattggggcttttaatacaagcattgatgacattaatgaaccacctgtatagttatataacgctccataaccataaacaagaacaagaattggaataattgctccaaacaatccaatgagcataccttctaacataaatggaatacgaatgtaccagttacttgctccaaccattctcataattgaaatttcagtagatcttgctgtaattgtaattttaattgtattagatatcatgaataaggcgacaataactaaaccaacaataaaaactgatccagctttttgtattgtattcaatgttgtgaccatactttgtgtagaatcaccaccataattaacagaattcacattaggaatatcttgaatttttttagctaaacttgcaagttttgttggatcttttgcttctacttcataagcagaacctaaaggattatcttcacgataagactcaaataactccttaccatctttaccttgtttatcgataagtttattcaactcttcatcttttgatgaatatgtaacagatccaacacctttaagttttttgatttgattccctacttctttttcagcattttcatcaatcgatctttctaatttaacataaatacgcacgccatcttcaatatttgctgaaatatcttgaacattaagtgctaaaacactaataacaccaataagtaataaagtaattgttacagcaaaaattgaagaaaaagacattgcaccatttctccataaattaaccaatgattctttaaaatgttttggtaaattttttatacaacttattaattctttcattataaatcatatcctcctaaagatgtatcagcattaatgcaaccatcttccattaaaattgtacgttttttatgttcttgtacaatcttttgatcatgagttacaactaacacagttgtcccttgttcttcattaatacgcattaatacattaataatttcttttgaagtttctggatccaagtttcctgttggttcatcagcaattaaaacttttggacgatttacaattgctctagcaattgcaactctttgttgttgaccacctgataattcatgagggaaagcattgaccttatcttccaaaccaacaagctctaatgttgctcttacacgtcttctaatttctacacgtggtgtatcaataacttctaaggcataggcaacattttcaaaaactgtttttttaggtaataatctaaaattttgaaaaacaacacctatatttcttctaaaataaggtactttactatttttaatttttgaaacatcttgtcctacaacttcaacttttcctgaagttggtttttcttcacgatataataacttaataaaagtagattttcctgcaccagttgtaccgataacatatacaaattctccaggttcaattgtaagatttacatcattaagtgctcttactcctgttttataaatttttgtaacatttgttagttttatcatttctattcagctcccaggagtattatagcacaatttgtaagttttgtttgaatattgagtctattaattatgttttttcatgttataatatgtttattgaaggagtggctaaatgaaaagaatatgccctagatgcaataatgaactatctaccaattgttatgtaaaagacaaaggaatcaatactttaagctatctagaattaattataaaaaaagatcaattcaataaagaacataaagaaattaaatcatgttactgtcctaaatgtggttatgtagaactttatgttgatgtcgatcatcaaaatcaacatttaaaaaaggatgatgatttaaattctttaagacaaactgtaaggcaatatgcgattgattatcatcaacacatagaattagaaagaaaaaagactgaagaaaaagaaattctagataaaaaaagaaaacttgaatctcttatttatcaatcacatatacaaaacgataaaaaaagaaaacgtaaaaaaactttacgtaaaacacatttactaaaaaaagtgctaagaaaatagcacttttttttataaatctatattaggtaatgtaaatcctcttcctcttacattatgtgtctcatttgtaataataaatgctgcctcatcaatttttaaaatttcattggtaagtgtcactaattctcggcggctgacaacagacatcaccgcatacatatcttgttttttataacctgtggtaatattcataagcgtgcatcctcgatctatttgatcataaagcatactttgaacctcattccattttggtgaaatgaccaatacttgaattttagattcacctaataaaatcattttatccatgaccaaagcagtaatcaaaacaactaaaataccataaagaatttgttcaacatttgaaaaaggaacttgtaaagctaggataatacaatcaaagccattaataagtacagtcgtagaaatacctgtttttttatttagaactaatggtggtatatccattcctccggtacttgctcctattcttaaaacaagtcctaatcctccacctacaaaaattcctgcataaacagaggataagagtaaatcatttgtaagatgtgtaacccccggagtattttcaaatattgttaaaaatgttgggaaaataattgtacttaataatgttttagctgcaaaagattttcctagaaaaaaatagcctgcaataaacataataatattgattacataaacaacaagcgataaaggaattcctgttatttgtttgacaattaatcctaacccagaagcgccaccaacaataatcccgtgaggggtaatgaaagcacaaattccaaatgctagaatagcattaccaataacaatcacagcaatttctaaacatttttttaaaaatttattcttcatgaccaccctcctgtatacgagatttcaaatatgcataaataaaatcatctaagtttccatctaaaacatctttaggattattagactcatataatgaacgattatcttttactaaagaatatggatgtaaaacataagaacgaatttgtgaaccccaagcaatttccttctgctcaccttgtatttcttttaattcttttgcttgtttttcttccattaaagcaaataacttactttttaacatcatcatcgcttgttctctattttgaatttggcttctttgactttgacaagtaacgactgttcctgtaggaatatgggtaatcctaactgctgaatctgttttattaatatgttgtccacctgctccacttgcacgataagtatcaattcttaaatcttctggtttaatgtcaatttcaattgtatcatctaattcaggaataacatcaatggatgcaaatgaagtatgacgtcttttggaagaatcaaatggagatattctaacaagtcgatgaacacctttttcagcctttaaatgtccataagcatattttcctttaaccaagaaagtaactgatttaatacctgcaacatctccatctaaataatctaaaacttctattttaaaatctttcgatgaacaatatctttggtacatacgatacaacatttctgcccaatcttggctttctgtacctcctgcacctggatgaatttctacgatggcattagcactatcatactttccagataaaagtaaaattttttcaaattcactcattctttgttcaaaatcttgataatcactttctaaaatagtttgaaattcttgatcatccgtttctttaactaatgtatatgtttcatctaataaatttaatgattgacaaagattttcatattcatcagtaatttttttcatatcatttaattcgtcatagatctttttagcttttgttggatcatcccaaaagccatcttgcattgtttgatatgaaagaccttctatttctcttaatttttcatcaatttgtgcagattttctatattcgtctattaataaatgggctttatcaagcccattttttatttcatataattccattatttaaattctacttctaattttaaatgaggaatattttcttctgctgaactaccaggacgaatacccatatgcacaatatttttagaaatcatatcaacaatagaaagtttcatttgttcaaacatatagaacgcttcttctgtatattcagaaagtgggttcttttgtgcatacgcacgtaaataaataccatttctaagtttagtcattgcatcaatatgattgatccaagtataatcaataactcctaataaaacacttctttcataattaacgatttttgcatgatcaatatctttatttaatctcatttgatattgagagaagcaaatttctgttaaagtttctaataatttcttaggatcatttttaacaacatctttattcttagcatcaatttcagcaagtaacatataatttttagctacaaaatctaaaacagcatccacatcaacttcatcatgtttaccatgagttgtacatctattgattgtcatttcaatcgcttgattgaacatacctttgacaatatcatctaaattatctaatgacatgatttcatcacgttctttatacataatttcacgttgttgtctcataacatcatcatattcaagaatatgtttacgtgaatcaaagttttgaccttcaacacgtttttgtgcattttcgatagcttttgaaaccattttattttcaatagccatatcatcatctaaataattgctaaatgattgtaatttttcaccagcaaatctttgcattaattcatcatcaaacgaaacatagaatacagaatatcctgggtcaccttgacgtccagaacgtccacgtaactgattatcaatacgtctagattcatgtctttcagaaccaataactgctaaaccaccaatttcaggtacacctttaccaagtttaatgtcagtaccacgaccagccatgtttgtagcgattgtcaccgcacctttttgacctgctcttgcaatgatttcagcttctttagcatggtttttcgcatttaatgtattatgtttaattcctcttttatctaacatttttgataaaatttctgaagtttcaaccgatacagtcccaattagaattggttgaccataagcatgtcttgcaacaacttcatcacataatgctttaaatttatttgtttttgtagaatagatcttatcattacggtcatcacgaataaccggtttatttgttggaatttcaataacacgcatgttatagatcatcataaattcttcttcttctgtttttgcagtaccagtcatccctgctaatttattaaatagtctgaagaaattttgatatgtgattgttgctcttgtttctgtttcttctttaattggaacaccttctttagcttcaattgcttgatgtaacccatcagaataagcacgacctggcataacacgtccagtaaattgatcaatgatcataatttttgcattacgaatatctcttgtaccatcttctgtcgcaatcatatattcaacatcacgagtcatcgcatagtttgcttttaatgcttgattgatatgatgaactaatgaagtatgttgaatatcatataagttatcaatcttaaatcctttttctgctttttcgattccttttggagttaatgaaacagtttttgtttcgatatcaacttcataatctttttcagcaattaatgatttaacaaaacgatctgcttgtaaatataaagcagctgtatttttcttaccacctgaaataatcaatggtgttcttgattcatcaattaaaatagagtcaacttcgtcgatcaaagcatagttaagtcctttaactaatactttatcttccattgaagtaaccatattatctcttaaatagtcaaaacctaattcagcatttgttgtataagtaacatcacaaccatgtgcttcttgtttttgttgaggtgttaattctcttttatttaatccaactgttaatcctaaaaattctaatactttaccattatttctagcatcacgttcagccaaatagtcattaacagtaataacatgaactccttttccagttaatgcatttaaataaactgggaaaatagaagttaatgttttaccttcacctgttttcatttcagcaatatcaccattatgtaatgcaataccacccattaattgaactttaaaagcttttaaatgaatttgacgccatgcagcttctcttgcaactgcaaaagcatcaactaaaatatcatctaattcactaccgctatttaatttttcttttaatacatttgtttgatttgctaattcttcatcagacaaagcactatacttatcttctaaagaaataatttcttgagcaatcttatctaattttttaagttgttttctttcatcatcgaaaacacctttaatttttgaaacaaagcctttttttgttttttgaggtgttgtagaaaatggaataacttctccattatattcttcatttttaaaatcttctacatgtatatcttcaccttgttgatcttgtaaatcaacaatatttttagctgcttcaacatcgattcctaatttagcgtttttctttttaatttcttttcttatttcttgctttctactagccatacatacacgctccttttacgcttgtaatcaagtttaattatatcaaataattgtgattattaaaagcaaaatttaaatatccctacttaaaataaaaatctagagattatctctagatttttacgacatgttttgcctgcataccgcgttcgctttgatataattcaaactcaactaattcgccttcattaagtgttttatatccattttgaacaatttggctataatgaacaaagacatcttttccttctcctcgatcaataaatccaaatcccttttcggcattaaaccatttgactcttccttgcactttcatcatcctttccttgtctatttcagtatatttaatattttataaaaaagttatcattttcattcgacaaataaattttacgtgtcatttataacaaaaaaatgtcatctctattgtcaaatagttcacactattttacatatttgttgaaaaagtaataaaaaacatttctagcaaaagcataaagcttacccttactattggttagtggttttcttagtgtctacaatagaattgattattttttaaaataatcaatatgagggcaagccaatactaatgcttttatttgtttagggtgatatttttctacttgctgaaatgctgcttgtaaagtatttgatgatgttatgacatcatcaaatactaaaacattcttcttataaagaagatttccctctttaatagataatattttctttacttggcttcgatctttttgttttgtctgtttgtagtcttcttttttatacaaacctgtaaaaatatgttgagaaaatgtcttaacaatttcaacattaggacaaaagccacgtcttttattatctttttgactactaggaataacaacaatgatataatttttgtaggtcctttttaattcttgaaatgattctataaaacaatcttttaaagcataatcatctaatgctttatattgaaaaaggagttgtctaaaaaaatcattgtattcatataaaaccttgacatgatatccttgaatccttatatcactatttattattttaaattttcttatacagcttaaacaaagagaagaattattcaccaagtgaaaaagatcttgttgttgatttaactctttatggcagataaggcattgctttgttgaagatccttgatacattctttaatagccttcgtttgtctatttgtataaatgataatatctccatttgtatagggtacttttcgccctgttcgccctgctatttgaataagtgtttctttatcaaaaaggggatgttcaccatgtaaaataataacttgtacattttcaacagtcattcctctttctaaaactgttgtacatacaataacatctatttcatgggatttaatcatttctaatgattgatgaatatttttttcttttgatgtagcacagtgacttttaatagaaaagaatttaagaaatttttgtacttgtcttgtcatttcaatacgtggtacaaaaagaaataccggttttttatctttttgatacttttttaattgataaacaagatgacacaacatcataaagtttcccattaccttacaagtaggaattggtaatggttgatgatgaaacctttgtaagacttgtacatctccactttcaatcgttgcagacataaacacataatttccctttatactattcattaatatattttccaaaacttcattatcacgatatggaaaagcatcatactcatctaaaatcaataaatcaaacattcgtggataccgatacagctgatgtgttgtacaaataataaattgtccttctaaacactctgtatgtcctccataaacaagaatgggctgaatattaaaaaattgtttttgaattctctttgctaattctataaccaattcttttcttggcatcgtcaaacaaacatgatgtcctaaattcaatgcatattcaatgacaccataaatcatttccgtcttacctgctcctgttactgcttttaatactgaattttgatgattttgatatctttctatcaataatcttgaagttctttcttgttctaagtttaatgaataatttaaatgatagtatattttcttttcatttttaacagattttaagttaactgtctttgtagaaaaagcaatacattttctacaataaatacgcccattgttttcaaaaaaatattgaacatcttcattttgacatctcgaacatttcatcttcttcacctacatctattttaatacattttacaaaataattcgtctcgaatttgtttcaaatttgtctcatttttgtctcaaatttgtttcacatttgtctcacgattttttcaataaaatcatttttgtatttcttagaaataggaataacttgtttatttttagtgatacaattcattccttctattctctcaacatattttaaattaacaatatagcttcgatgacaacgacaaaaagaatcatctaattgtaaagctatttcttttaaactgagataatttctttttgtcatatcattttgatgaatcataacatggtgttgataagcttctatataaataatgtcttcataaggtattttgtgaacttcttttttaaactgataaataaatgtcttagaatgttgatgtaataaaacgcaatcaagtattttatatatttcttgttgatcaagcggctttaataagtagtgcatcgcttgtacttgataacttgctatcccataatgtgtattttttgtttgaaaaacaatcggtattgataaatccttttttcttaagatctttgcaaattcaaaaccattgatatgtttcatatctaattctaaaaatacaagatcacagttttttaaacattttggtaattgataataaagctgtttataccaatgaaaatagatttcttgttgtttttctataccccatttttcaataatcgattttaaaaaaacataatcttttaaattattttctccaataaaaatattcatttaatcacctctttatcagtgtatattatttacaatctactctatgattttagaacaaattggactaaaaaaaatcgccgaagcgatttattgatcttgatatactttttttaatgcatcttcaacacactctggcactaagcctgtaagtggcttatgataactagctatttctttaacgacagatgatgagataaaagaatgtgatggctttgtcattaaatacattatttctatttgactatttaaatattgattagattgtgcatattgtaattcataatcgaaatctgttgttgaacgtaagccacggataagcacttgtccattgactttttttacataatccataaaaagttcatctgttgaatcaacaattacattttttaaatgagctgttgctttttttaaaagttcttttctttgttcaatcgtaaacaaacctacttttgttggatgaatagctaccgttacatataatatgtcaaatatctttgcagcacgttcaataatatctaaatgtccatttgtaactggatcaaacgatccattatatacagcaattttcttcatgatttaatcctcataataaaaaatattaagagctgtaattccatactcttttcttttatttaactcaattccttctatttctttaaactcaacttcttttaattcttctactacaatacacgcttgtggattcaacatttgatgatcaactaaatattgaagaatatcatcaacaagaccttttccataaggtggatctaaaaaaacataatcaaactttatacctttttcatacaaatattttaaagcttttttataatccattttcaaaggaaaacaattttccaattttaaaagagaaaaattttctttaattgttttaaaagcttcgtattgatgatccacactataaagtgtatcacatcctctagaaatagcttctattccaagtccaccactacctccaaataaatctaataccgttcctccttgaaaatatggcccaatcatattaaaaaggttttccttatttttatctgttgtcggtcttgttaattgactcttaggaacttttaattgtctttttttatactttcctgcaatcactctcataatttataccctgatgtatctaatgaatcactaatatctttaaaaacaatttttgtaacttcatcgagtaattcattgattttataataactttgataatatttttgaatgttttcattttgtgacattctttttcttacttcatttaattcttgtcttttctgtgtcaaatcaatatatttttcaaactttttcaaatcatctaattcttgtaaaagattttgataattatctaataattcttttgtttcttgatttaataattttaaagattgctctttaaattgtagatagcgcttatcttctttgatagcatctattaaatcatatattgtttcattcattgtaacatctccaacatactcattagtattgatattctttctagcttttctaaaactgtactttgttttttttgatgtatttcatctaataaatcatcatatttttctggataatgacataatgtaacataccaaacaggatgcttacgtatataatctaaaacatcttctttcattatttaccttctttatttttatctaaaagattagaaacaattcctaaaactttttcgattgattgcaaagaagaagataatgcttccaaatcgacatttttgataatttctaaaacattcatattttctattggatgttccttatacggtttgaaaaaatgatcatcttctccatacattgtatagatttcatatatttcttgccaagtatagcgatgatttaatacatcttctttaatacttggtattgtctttaaaaaagctttaaactcttttaaattatccatcaaatcacctaatatatcatatgaaacatttataattgtgtgtctgttttttctagttgttctttgttgaacttggaaataattgcttgggcaatacctattgctattaaagcagcaatcgttgaagatcccccagatgatactaataataatggaacacctgtcattggaatcaatcctgaaacgccacctaaattaacaaataaatgtaacataaaataagaagctattcctatcaaaataactcttgatttgttattttgaatttgatctgcatattttaataatctaaaaataataatagctgttggaataatcattaaagccaacccaaaaataccaagttcttcataaataatggcccctataaaatcattatgtgcctctggaatataatcatatttttgaatagaatttcctaatccaagtccaaaaataccaccatctgtaaaagcaatcaaagaattgacaagttgccatgaactatcataaatattttctatttttaatggttttaaccaagaatcaatacgttgtaattgatatccctgtaaaacagctgtgattaagaatcctaaaataataactgctacagctaaagcaatccaaacgagttttttatattttttataataatctcttggtgttgacataaaacaaataaaacaaattgctgctagaataagagaacttcctaaatccttttgtacaataactcctattccaaatgcaaaaaccataagagctaaagggaacaaaacacatttgttaaatttatctttataaaatttactttttaattcagcagttctaaattttccttttactacaaatgctgaatcagtttctgtaagcatataagataaaataagaaccataccaattttcataaattctgctggctgtactgtaaaagaacctaaatgaatccaagcatgtgagcctttggtcgtccaaaaaacacaaccacacattgagatgattcccataatatatacagccattgaacttctgtaattaatcattttcaatttaaaaccctttgtaagaaccatcataataaaaacacctattgctacataaatagattgtgtaatcatattttttattgcaaatgccgttccttttgaagagaccgctccaattgatgctgaaccaatcattacaattcctaaacaaatcaatacaaaaactgcaaaaaagataggcttatctgcccctttttttctaaaaaaagcttttattctttttgtcattataatttgatccaatcattttcttgacttgctttaaaaactttataaatagaatatccagaaacatcttggaattctttatcaatttgcttttcttcactctttgtcccaacaacatttttaaattttctataagcatttaaaaaatctgttttacttattccttcttcatatgctttttctactacattatataaagacataacatcaataatatcttttgttgaccatgtatagtctagtggataattatagtccatcatttacacctcatttcagtaaaatattataacttaaaaaagtataaaaataaatgacttatgataaatcccccatacaattatttgaaatcataatatggtaatagtaaaggagggataaacaatgaactgtgattataactgcaatggatatgtcaataatccatttggctgtggtggatgtaacacatgcggctatacacctattatgggtggctttggttgcaacaatacaggatgtagttggtttgcaattgttttagttgttttcttattattaatcatttgtggtaattcaagaattagaccttagatatttcaatcacctcaaaatatgttataataaccacgaatgaggtgaaataaatgttattaatgaaagatattatagatgattcaaacgaattaattagaacagtgtcaaaagaggttgaacttcctctatccaaagaaaatcatgatttactcatgaaaatgcatgaatttttagttgcaagccaagatgaagaactttctgaaaaatatgatttaagacctgcagtaggtattgcagctattcaacttggtattccaaaaagaatgtgtgccatccatgttttagattatgatgaagaaggaaatgtaacaaaatctactgattatgctttagcgaatcctaagattgtttcttatacacctaaacaatcttatttaaaaactggagaagcatgtttatcagttcctgaagatgtaaaaggttatgttccacgtcatgctaaaatcactgttgaaggatttgacgtacttacaaacaaagatgtaaaaattgttgctcgaggatttttagctatttgtttacaacatgaacttgatcattttgatggtgttttatattatgatcatattaataaagaatatccattagtaccaattgaaaatgctatggttattgaataaataaaaggttctttcgaaccttttattttactttaaaataatgaattgttttgggttttaatactatttgtccttgattttcaatttcttgttgatcaattaaagaaataagattttcatttaaagaaatggtaaattcttgatcatctaaatttaatgctacaataattctttcttgttgatcatttctttcaaaaacaaattgtttatttgttaaaaccaattctttaaactcacctttttgtaaagcagatgattgatttctaatagaaatcaatttttttatatattttgttaaaccattaggcattggtttggtaaactctggtcttaaagaatcatcactttcctgttctttctttccggtttgtccccattcacttccataatagatacatggtattcctggtaaagaaaataacataccataaataagtggtaatttttctaaatctgttaatttagatgctattctttctacatcatgattatcaacaaaactaaataatgtttgtcctctatacatttctccataattacgttttattgtatgagccatttcaaacatatttaatgaattaaatgaagaccaaagtcctttaaaaccaggataatcagtaatactatctaaatgtgcttcactaaacatatatcctgcattatcacctaaaacttcacctaacaagaaaaaatccgcctttttttgtctacaatgatcttttaacattgccataaaccatcttggtaaactataggcaacatctaaacgaataccatcaatatcaaaggcatcaatccaataatcaacagcacttaataaataattttgaacatctggataatctaaatttaatttaactaattcataatgtccttcccatccctcataataaaaaccatcatcataaggtgaattgccgttaaaatcaattctaaaccaatttttatattgactattttctctattatttaaaacatcttgaaaagcaaagaagcctcttcctacatgattaaaaacaccatctaaaacaacacgcatccctctatcatgtaaatttttacaaatttcaataaaatcttcatttgttcctaaacgttcatcaattttacaataatctcttgtatcataaccatgatgatcacttgaaaatacaggattaaaataaatagcatttatccctaaatcttcaaaataatccataaaatcattcaatcttaaaatacggtgttccacaattccatcattatcacgaggagccccacaaaaattaagagtataaatttgataaaatacactttcattaaaccacattataaaaaacctccttatacatctatctattattatacactatttagttagagttatttaaaaaatatgatataatatactatatataaggaggttcttattatgactcaaaaaattattactattacaagagaatatggttctggaggaagattgattgctaaaaaagtagctgaagccttaaatattgctttctatgataatgaacttattgatgaaacagcgcgccaattaggtattgatattgatacaattcgtaaagcatctcaagaaaaatcatcaagttttgcttattcacttaataatggtcctcttattttaccaattaatgaccaagtttatgctacacaagccaaaatcattaaacatcttgctgaaaaagaagattgtattattgttaatggatgtgcaaactatattttagaagactatcctcatgttttaagaatatttgtgtatgctcctttagaatctagaattgaacgtgttgaaaaagattataaagaagaacatgaaaatactaaaaaatatgttcaaaaaagagataaacaaagaaagagttattataattattacacaacaaatacttgggcaaatatgaaagactatgatttatgtattaatagtgatatgggaattgatgaaatcgctcaattaattgttaaagtttatcaaaacggaaaattatggaaataatataaaaaatattcaggacaccctgaatattttttattctggtaaaaattgaattgctactcctaaaagtcctgaaccaagataacaagataaagcagcaccaacatgaccatcgattatatatgtaaattgaggaaacctttcttttaacattccttccaaaatatttctttcttccaaattattagcatctgcaatagctaatgcaaatttttgatgtagattttcttcaagatgactttctattaaatctatcaattttgatttcactttctttgaacctctcactttagctggaacataaatttctccattttctttttcaaaagaaagaattggtttaatctttagtgttgttcctaaaaatgccgaagccttgccaatgcgtccacctctttgtaaataatttaaatcatctattgaaaaataagcataattttgatagcacaaaaaatctgcaatttcaattaattcatcaaaagattttccttcttctctatatttagcaagactaacagcaataactcctaatcccactgatgcacttttactatcaacaatatgacattttaatttctcataagtttgacaaaataacctcatttgattacctgtcccagatataccactagataaaaataaacctataacatgtgtatatcctttatcttttagttgatctaataaattaaacaaatcttttccaactggtgaagaagttttaattactttttcatcttgaatcgcataaatatcattagaagtaatatctacaccatctctataactctttccatcatattgaatttgtattggtaaaacatgtatatcatataactctctatattctttttttatatcactacatgagtctgttataattgcaattttttccatttatatctccttaaagttactttgaacttcatactaatgaaacttattataactatttgtatataaaaagcaagattttttaaaaaataagtatcgcatcaatgatacgcgaaacacattgaactactaccgatcccatcattaatgcacctaaaatgatagtaactaatcccttatttgataatttttccataatagttcctccttttgtttctttaatttcaacttttaaaatttatttttgttaatgtatctttttaagacacttataatataactccgtcactaagtttcgtcaatacttttgtgtcttttttagatattttgtttactacatagtctataatatggtaatattaagacacaaggagtgataagatgacaggtgaacgtattaaaaaattaagaaaagaaatgggtttgactcaacaacaactaggagaaatgcttggtgttcaaaaatcagcaattgcaaaatatgaaaacggacgtgttcctaatttaaaaaaggaaacactttcccgacttgcagaaatatttaatgttactcctaattatttattaggtattgatgagccagcctatcatggacatagtcataatatagatattcccttatatagtgatgtttgttgtggagatggtatttttgttgaagacaatattgaagaatatatttctttacctgaatctctattaagttctcgaaaggattacttttgtcaatatgctgatggagatagtatgattgatgaaaatattcaatctggggatcttattatttttgaaaagacacagcaacttaataatggtgatgtgggatgttttggcattgaagataatattgcaacatgtaaaaaatattttaatgattctaaacaaaactgtataattttacaacctgcaaatgataaatattctccaattattattaatgaatataattatcatgaatttaaaatcattggaaaacttgcccttgttatttctaaaagaaactaaaattaaaactccgttttaaatgaaacggagttttttttattaattttaattattttactgtaattaattctaaataagaagtagttccagcaacacctggtgtaccagcagtaacaatgatttgttcacctggttcaactaagttttctttagcgataacttgagcatattcaatcatagcagctcttgtatccatttgtttacataatactgatttaacaccccagttgatagctaatgctcttgtagtttgttcatttggagtagcagcaataatcatagatttagtacgatatctagacatttttctagctgtaaatcctgaatcagtgaatgcaacgattgcagcaacattgaatttagatgcgatttcagcaactgacatacagatagcttcactttgatctaatggagcagttctgattgcttttctttgtaatgaagcataatctaaagttccttcagtttttaaagcaattttagtcatagtttcaacagcttctactggatatttaccttgagcagattcaccagataacatgattgcatcagtaccatcatagattgcgttagcaacgtcagatacttcagcacgtgttggtcttgggttttcttgcatactatctaacatttgagtagcagtgataacgattttacctgcagcacgacatttattgattaattctttttgaattaatggtacatcttcagcaggaatttctacacctaagtcaccacgagcaaccatgataccatcagcaacttttaagatttcatccatgttttcaacaccttcgctgttttcgattttagcgatgatttgaatttcaggacgaccattttcaattaataattttttaacatctaaaacatcttgtggacgtcttacgaaagatgcagcgatgaaatcaacaccttgttgacaaccaaaagttaaatctccgatatctttttctgataagtaatcgaatcctaatttgattcctggaacgttgattccacgtttgtttttaacaacaccatcgttagcacagatacatacgatatcagtaccttcaacatgatcaactaataattctacttgaccatcgtttactaagatgaaaccacctggtttaacatctttatataaatctttataagtgattgtaaatttttcacttgtaccttcgatatcttctacacagatagtagaaacttgaccttttttgaattcagtttttccaccaacgaaatcaccagttctaatttcaggtcctttagtatctaataagatagctacgtttttgtttaattctttattgatttctcttaaagttttaattcttccaccatgttcttcaaaatcaccatgcgagaagtttaatctcattacgttcataccagcttgaactaatttagttaagacttttttatcttcagaagctggtccaattgtacacacaatacgtgttttcttttttctttctttttctaataccatcctaatatcctcacaatcatattttcatttaagtttatattaacgaagtttaatagcatcttcgtaaatactaaaatcagtttcacgtttatgtcctaatacttcagtaattggtaatcctttgatttgaccatttacttcacttacacataaaccaccttttccagcttcaagtaattcaacggcataaacacccattcttgaagcaagaactctatctcttgctgatggtctaccaccacgttgcatatgtcctaaaacgtttgcacgagtttcaaaaccagttgctgcttcaacttttttagctaattcatgtacgtctgtaatatgttcagtaattacaacgattgcatgttttttatcagaagcttttgaagcttttaaagtttcgatgattttattttcatcataaccaatttcactagtaataacaatttcagctccatcagcgataccggcattgatagctaaatctccacatctacgtcccataacttcaagaattgtacatctttgatgagaacttgatgtatctcttaatttgtctaaagcatctacaattgtatttaatgcagtatcaaatccaattgtatgatcagtatcaggaatatcattatcaattgttcctggaataccaatacagttgatacccatttcagttaattttaaggcaccattgtagcttccgtctccaccgataacaactaaagcttccattcctacttctttcattttttcaattgcttcttttctaacttcaggatctttgaattcagggaatcttgctgactttaacatagtaccaccaatattaatgatgttacgagtactatgacgatcaaacttaataaattctccatcgtgtaatcctttataaccaagttttacaccatatacttcaattcctttatttaagcatgtacgcgctactgctcttacagcagcgttcattcctggagcatctcctccagaagttaaaactcctatacatttaaccataatgttcactccctatttcataacatttcatacatagtgattttagcacaaatcatgacttttctacaagaatttttacacatttattatgctaaatcttattgttttatcataattggcatactcattgtaaatattgtgttaagtaagcgctctacttttattttttcacgcgcatcttttttcaaagtatagattttaattaaatcatcttgggtgtattgactggtaaatagcgttatctttttattttgattacgatatgtcaatacagctgctaaaacttcatctcttgaccagcctgttacattttctccacctagatcatcaatcactaaataatctacattacgaagttcctctatattattatcatttccaaattcattaaaagaattctttaaatcgattaaatatgtaggaaaatgcacatatcctaaatgatacccttgtttagcaagtgatcttgttaaaaaaccagctaatgttgattttccacaaccagatggcccacaaataaataaacctttttttgacgtattcgataaaaaatgatcaattgtacttgcaagttctttgttcataatatctttaattgattttaaatcagataataataaatcatcactcacatttgaaacagtaatatgacttaaaatattttgcttttctaatatttcttttccatacttacaagggacaagtattgtttttaaatgatgattttcaacatgaaccgcttgcttcattcctttagaaactttatgacattgataaagccccatacaatctttacatttttgcacatcttcttgaaaatctaaaaattcaacccaattttcttctataaaatctcgtcctacttgtccatcagataaaactttcattatgtacggatcctttataagttcattgatactttcttctttttgtttttgaaaattttgatcatcatcaaataaatgtaaatcttgtaaactttgcattttttctcctcctagtcatatttttctaacattgcaagagcatcttcatcaatattatctgctgttgatttttcttgagaaacaatttgaatatcttttgtaaaatcatcccagtcatgatgttgctgattttgatatttcaaataagcttttccttcttctatcgcttcttgaaccgtttttattttttttcttttccattgacttcctaaagcttctataaaatttttaggtaatgattgattacacttttgaagtgttgtttctattaaaacattgacaactcctggctctaattgtaacgttgttaaaacagattcgacaacttgaagatctctttttaatggttctttaccacccgttttatcttttaataaatcataaggtgaaatattttctaaataataaatatgtttttgtaaagaagattctccctgtttttcactttgaagcaaaggggattgcttatgaaatacctctgtaaatttttccggcatttttaaatcataatagtttcggcagttttgagccaataaccgactatttaaatgattttcaatcattgattgtttgacaagatcttgcatatctaaagcattgatatgatataagattcctaattgttgaattattttttcatcttcttgatcaaacattttcttagataattgtaaattttcaatgccttgataaaacaacgttagatcgtaactattttcaatagaattttgtattttttgtttatattttttttcttttaatatatttttttcatgatgatgaatttcaaaaacatctgtaaacgatgctgtcatttcttgataatcatttaaattaacattatacgtttgaaaaatcgctattgttttttcatattcatctttcaatctatctttcaataaacgatcaagaatttgatgattaataaattcttgaggtgataacggcattttcaaatcaaaaagataacgattatcattcgtttgtttaacatatgaacatacaagtcctacagcttctaacttatcaaaagattcctgtaaagaatttaatgaaaatcctgataatttacataatctagaaatcaaagaaggactttttgtaagtgtcatttgatccaattcactattgagtgttagataaagagcagtagcttccatcccaatcaatggttgataaagttgtaaaactgttttataacctgttaaatcaagcatataactacttcttacttgataaacatcactcgttaataatttcttcatgactgatcctttctataaattcatcaatttgtttatataactcttctatcccttgattgttatcaaaaacaatatcggccatttctcttttctttaaagaagaaatttggttattgataattgtataagcataactttcatcaatatgatctcttgccatcaatctttgaacttgtttttgttcatctaaataaacaacaataatttcatcacacaaatattctaaatgagactcatataataaaggaatatctaaaaagatacaatctctctctttatttttttcaatttcttccttcattttaaaaatcacataaggatgtataatagcctctaactgttttttagcatttttatcatgaaaaacaattcttcctaatgcctttcgatcaacaattccatctttaacacatccaaataactcttgaaccttcaaaatacattcttgatcaattgttagagcatttcttgaaatcaaatccgcatcaacaacaagataacctctttctattaaataatgtgtgactgtcgatttcccacatgcaatacttcctgttattccgtatactttcatcgttttgccttttgacatattggacaataatatgttcctctttcattaatcattactttttttatctcatgtcctaatggacaatgcttttgcatatgcacttttaattgcacttgaaacaaaccatcaattccattagcactaaaagaatgaattgtcgttccaccttgtaaaatagccatatttaaaatctcacaagcaacatccactaattctttaactctctttttacttaaaacattggctttagtataaggatttaaatgcatttgataacaaatttcatttgcataaatatttcctatccctgtcataatactttgatctagaagaactgttttaatcgctttatttttctttttaagcttttgataaagctctaagtaatctatttcaaaaggttcagggcctaatttgcttaaaggcagttgatttttataatcatcatgatccaccaacttcattcttccaaactttctaacatcattatatcttaactccataccctcatctaatacaaagataacatggtcatgtttagaaagtatatccccttttttacatatttgatactttccttccattctaagatgagaaataaaggcaacatcctccaatttaaaaatcaaatatttccctacacgatcaatctctgtaaaagtcttattttttaaagtttgtacaaattcttcttgatcatcatcaatgattttaggatataaaatttttatatcttcaatttttttatttaaaataaaattttctaatgttcgtcgaaccgtttcaacttctggtaattctggcattttttcacctactttaactcataccaatttttagcgtaagttccttccgcttttaattccactttcatttgataagcactttccattccttcttttacaagtttcatcattttatccaattcatcttgataaacatcaaaaatcaactcatcgtgtacttgtaaaatcatttttgatttcatatgattttcttttaataattgatccactttgatcattgcaagcttgataatatcagcggctgatccttgaattggagaattcatcgctaatctttttccaaattcttgtctcatataattcttttcattgatttctggaatatatctttttctatttaagacagttgaaacataaccattttcttttccaaaagcaatgcttttattcatatagtctttaatctcagcatatttttcaaaatatttttcaataaatgatttagcttctttaacagtgacacctaattgttcagccaaaccataatcagacattccataaataattccaaagttaacagcttttgcatttcgtctcattgttgatgtaacctcttcttcacttacaccaaaaacaacacttgcggtatgacgatgaatatctttatcatgattaaaggcatctattaaacttgtgacattggctagatgagcaagtacacgtaattcaatttgcgaataatcaaaagatattaaataatcatattcaggaacaaacgcttttctaataagttttccttcttctgttttgactggtatattttgtaagttaggatctgttgatgataaacgtcctgtttgagttaaagcttgattataaatagtatgtgtctttccatcaataaagatttgttcttgtaacccaataatataagttgaataaagtttacttaatgtacgataatttagaactttatcaataattggatgaacattttttaatttatttaaaacatctactgatgtggaataacctgtttttgttttcttaccattaggtaatcctaaatcctcaaaaagaacttctcctaattgtttaggagatgaaatattaaattctttatgtgccaataaataaatttctttttctaattgatcaatttgtcctttaaaagtatctcctaattgttttaaaacatctttatccattttagctccttgaaattccatatccgctaaaatatacgctacaggcatttcaacatttttgtataaatcaaattgttgatcttttttcaatctttgttctgcttcattttttaattcataaattgctttagcttgtaaaacataatgtttcgataagacatcttcttcaggaacatgttttttagcaccttttccaaaaacttcctcatcaaattgtaaatcaaaatattgataataatcacaaacgattttaatttcatcttttaaagaaggatttaaaatataagaagcaagctgtaaatcaaaagtataccctttaacttctaatccatgccaacgacaagcattgatacatttttttatatcataaccatatttttcaatcttttcatcttttaagaaagacttaaagttttcatcatgcatagcattttctaaagaaatataataggcttcatctttattataaagaccaaatcccaaaatagccgatttatgataattcgtatcatagactcctgcaattaaagctgtattctttttaatatttggtaaagtttcaacaattttatattctaaaggtttactttgctttgtttctgtagaaagagacattcttttaagtaaagagttcatatcataacgtctgtaaaactccgcaagatcatcattatattcttgtccttcatatttccaagcatctaaatctaattcaacaggtgcatctgttataattgtggcaatctttttagataaaaggcccaattcaatattcgttctaactttctcacccattttaccttttaattcatccatatgttcctttagattttctattgtcccatattgatttaataacttcaaagccgttttttcaccaattcctggaattcctggaatattatcagcactgtctcccataagacctaaaagatctctcatttgatcaggttctaaattatatttttctttaaaactttcaactgtaataacttcataatcattggtcttttgaggctttttgtattgtttaacatttgaatcaatcaactgcatcatatctttatcatttgtataaacagctacttccatgccttgatttgacgcttttttagaaatcgttccaataatatcatcaccttcatatccttctttttcaatataaggaatatgatgagcttctaaatattctctaaccattgaaaactgacaaacaagttcatccggtgttggctttcttgtccctttatattcttccaatagctcacttctaaaagtcttcccttttgcatcaaaagcaaccacaatatactcaggattttgtttcaataaactttctaatctattagcaaaaccataaactgcattggttggtacaccatctttattgaccattaaatttcccatagcagctgttgcataataacaactaaataaccaaaaattcccatctattacaactaatttttccattttatacctcatttacttctttaacattttgtaccactaaagaaagcttatctcgataattcatctttccttcaatacatacaatcttatttttttctaacaatgtcttatatctttgatacgttgaagaaaaaacgactccctcaacatttcctgtttcatcaaatccttcaataaaacacatttcatttccttttttatcaacgatcactttgaccctaaataaagataataatactctcacattttttgagacatactcatttaaatttgcgactgcaagaattggttgattgattttttgtttcatataagccaaaggatgttgtgttaaatacacacctaacgctttcttttctaattctaaacgcaccattttattttctttaataatttctaaaataggtggttcatcaataccaatcatattttttaaatgtgcatactctgtaatcttttctaaattagcttttaaagtcgcacgattaagtccaaattcatcaaaagtacccgcatcaattaaactttctaacattaaactcgtgattttctttccttccattcgcgaaacaaaatcaaaaatatctttaaacaagccattcttttgtctttcttcaacaattgctagataacctgcctgtcctacatttttaatagctaataaagaaaaacgcaaatcaccttctacttgtttaaaataatgttcagaataattaatggatggcggtaaaattctaatttgatattttttagcttctgcaatatattccattttatgaacatcactattttgttcattagaaagaattgctccataaaaagataagggataattagcttttaaatacgcaagttgataaccaattaaaccataggcaattgcatgagctttattaaagccataatctgcaaacttttcaattaatccaaagatatattctgcctgatttttttcataaccattttttaaagcaccacttataaattcctctttcattgattccatcaacccaagtgtctttttagaagttgcttgtcttaatatatctgctttagcaagtgaaaaaccagcaattttttgtgctacttgcattaattgttcttgataaataataataccatacgttgattttaaaatatcttttaaatcatcatgtgggtattccactttttcttgatgaaattttcgagcaatataatgaggaatttgtgacataggtcctggtctatataaagcattggcagctccaatatcttcaatactgcttggctttaattttctaaataaattcttcatccctggtgattctaattgaaaaacacctaacgtatctccatttgataacatcttaaatgttttttcatcatttaaaggaatcgtatttaaatttaaatgaacaccttcatacttttcaatattttttaaaatatcagaaattacagttaaattcttcaatcctaaaaaatccatttttaataaaccaacactttcaatataatttttagaatactgtgtcaatacattttgattaggaccttttgttagaggaaccacttcatttaaacaatctcctgataaaacgacccctgcagcatgcattgaaatattacgtggtaaacgttctataagatagattgctggtaaaatctttcgtaacatttcttcttgattgaccatacttgcaaaagcataggaagattcataaacttcttttactgtttttcgattttttccttgtgttggaatatactttgacatcatttctaatttaggtaaaggaactgaaacgacttttcctaaatctcttaaagcaaccttaggcccataggtagcaaaagtaacaatttgtccaacatgttcttgtccatacttttctgtaacatatttaacaacttcatctcttttatcatcttgaaaatcaatatcaatatcaggcattgaaacacgctcttcatttaaaaaacgttcaaataataaatcatattttaaaggatcaatattcgtgattcctaaaacataactcactaaacttccagcagcacttcctcttcctggaccgacttgaatatcatgtgttttcgcaaatcttacataatcaaaaacaatcaaaaaataatcattgaagcccattttagcaatgacttttaattctttttttaaacgttctatataagttctaggaacttcttttcctttaaatcttttctttaaaccaacaatacaaagttgctgtaaataattttggctcgtcacattttcaggtaaaggatagtgtggtaaatgcatttgattggtttcgatagtgacattgcatcttcttaacaaatcatttgtattttctataatctcgcgatcaaacaataaagacatctcataagcatcttttaaatacatctgatttgtttgtactttataatttcgatcaattttttcgccatggatacttgcttgcattaaatcaaccgctatagcatcttgtggatataaataacgtacttcattcgaagcacaaaccttcacttcttgtaaagtggcaagtgcttttaaacgttcatttaaaaatgattgcatttttaaatgatgatcttgaatacaaatataataattatctttaaacatctttttaaacaatgcaatatattttaaagcctcagattctaactcttttaaaacaagcctttcaacaattccttctttacatccagaaagaataaaaagatgttcacgatataaagataatttttctaattcaatcgctttatgttcacttaaattaatatcactacatattttcattaaatcatgataaccaatttgatcttttgcatagaataaaaaaggataaacttcttgatcaataagtacatccccttgcattccaaaaataggtttgatgtcataatgatgacaagcattagaaaattcaatcgcaccatacatattattgatatctgttaaagccaatgcttccatatgcaattctttcgctcttttacataaatcttgaatcaaaatcgtactattttgaaaactataacaactatagatattcaattcaccaatcatgttgccaccacctttttccatattatacgctaaatcatccttgattaaaagaattacaaaaatgttttcaaagataataaaattaaaatcaaaccaacatataaagttaaaaataaatacagcatttcaaaaaaagaatacgttaaaacaagcataacaaacaacctatagatatataaaataactgcatagtaatgataacgaatctgtaaaacacaaaatcttctttgccaaatgataatgacaatagataaaaacatcgctataaaatgaaaaggtaaaaataacgaagacaaaataatttgcaaaatcaaacaaatccctactagaaactgcatttttttgattctaattaacataacaccaccattttattttatgaaagaaacaaaaaaagagcacttatttagcatgctcttgtaaactttttgcaagctgtgctggacaacttgttggttttgctccacatttgatgtcttttaaacgttcaataacttcatcaactttcataccctttgctagtgcagcaactccttgagtatttcctgaacatccacctgtaaagataacatttttaacaatcccatcttcaacttctacatggatatttcttgaacagacacctcttggtgtataatcgtattccatttttattccttcctcctatttttttgtaagtttagcaattgatgtcacatatgattgatacatatgactatctactgctttgatctcttctactttataatattttgataattcttgcaaatcttttgcaagcatagatgttgaagaattcatataaatgactgtttgtacttttccaagtcttaaagtatcctttaattcattagaaatcccattgactccttgaataatcactgtatcatacactttcttttttgcaaaagtaaccatttttttaattggttgaccataaacaaatttaatattttcttttcctaataatttagcattataagtagcactttcaatattatctttcttttcatcaatagcaacaacttcttgatctaaattcatttctaaaataccattttcacaattaatagaaataatctttttacttcctttgaccattgttttaacaatcttatttctaatttcaaaagattctaaatgatctggtaaagttgttttaacagacataatatattttttaccatcacaaataaattcttctttcgtatttccaaaaatcttcttataaccttgactttcaaaatcttgatatttagaagtattaattgacataaataaaccattgacttgttttaattttttaatatcacttaccacttcatcttttaaaccgtctttccctgtaataatgatgacttgtactttatcttggaaaatacgtaatttaataaatcttaaacctgttctaaatttatcattatatgttttgcattgatgattattaaaaacttcttctaattgtaataatgtttgattaattaatggatgttgtttcatacaccctgtcatcactgttaaatattttgtttctctttgataaatcccaaaagtaacttttcctttaaaatctacaattggtaaattagcttgtgtaaggaaaccatttttttgattcatcccaataatttgatcaatcttaatttgtgaacgatctaattctgtatacttctttaaagattctttaattaaatcttttttatgttttaattgtgctgggtaagcataatgtaataaattacaccccatacattctttattcgcacgacatggatttttaacacgcattggtgaaggtttaatgactctaattaaatcaccaaaataataatttttattattgtattgtttggcatcaatttctacttcttcatttaataatgcccctttaataaagacaattttacgattaatgtaaccaataccttctccattgattcccatttttttaatttcaactgttgttttcatatagcctccttaaaaaaggaaaagcatcttattgatgtttttcctctccttcttcctcttctttcatttcatgtattattaatctaagaagttcaattcgattcttatgcatcttttcgataataattgtaactcctggaaattcaattttatcttttattttaggaacaccactaaactctcctaaaacaagaccaccgattgattcaaaatcttccgattcaaaatgagtatcaatttcatcattgacctcatttaaatttaaactaccatctactaaatactcatgatcattgattttaacaatatcatcacttgtatcatcatattcatcatcaatttcaccaacgatttcttcaacaatatcctcaaaagtaacaattccactcataacaccatattcatctaatacaatagcaagtgttgcatgttcctttctcattgaagcaaaaacatcattgacttgattaaattcatagaccacaaaagtctctctcatatactttttaacatcaaaatgttctttatcaatatcgataaacaacaaatctttcatatttaaaacacctataatttcatcaaaagactcatcatgaataggatatctagaatactgtgcatcatgataaacattcattaattcatcatatgtacaatcttccggtaaactttcaacatgaatacgtggtgtcataatctctttgatttcagtttcaccaaattcaaaaacattatgtatcatttctttttcttctttttctagaacaccttcttcatgtccaactgttacaattgttttcaattcttcttcagttaaactagggccatgttcttgattaccacctaaaagtttaataataaatcctgtaataatattcaacacaaaaacaactggtttagtaattatacaaacaaaacgaataaatggtgctaaagcaaaaactaatttatcagcgttttgagtagcaagagatttaggtgtgatttcaccaaaaatcaaaatacacaatgttacaacacctgttgcgattgcaactgtttgtgcaccatctccaaaaatagccataatcgttgctgttgtaagtgacgaagcaccgatatttactaggttgtttcctactaaaatagcacttaataaacgatcttgattatctaataaagactctactaattttgcttttttatttccttcttcagcaagtgtacgtattttaattttacttaccgataaaaaagctgtttcactacaagaaaacaacgatgataaaattaataaaatgattaatgatatgatattcattatctgggcagaatccacttttacatttctcctttgattctattattgaaaattataatagtataattacaaaaatttgtcaatattccattatttttgtataaagtttatgtaatgatgataaaaatcatcaatatcttcatcatatacaactaacacttttttacctttgattcctaattgataatggtcaatttcaacaacttgatcaaaatacattgattttctttttttaaatttctttaaaacattttgatatgtattatatccaatttcatcactacgccatgaacctttttcttcaacgatttggtcaatctctttatcacttggcattcttgtttgtctttcacgttcaagaaccaattctttaaaaatattttttgaaacaaaagtatttaaacattgataataaccttcaaaagaataaattgcttctccatcatctttatctttacctattttttgaataaaagttgtcgtatcaacaagtagatttgaattattttcatctatccttttattttttggcaaagtgatcgtcatttcttgtttatctaattttgaaaaatcaatttcattatacaaaaagtaaacacctacaaaaacagcaacagaaacaatcactgctattttctttttgattggatttttaattaaaggaatttttgtattaataattgtcgcaaataatgtaattaatataaaataacccaaaaagcttaaaagtgaacttaagttattcatttttaaaacaaataacattccaatcatcaaaatagctaaaatatctataacaatgcgaacaaaaccatctaaatatttaaacttttgataagaatacgttcttttctttaaagcacgtctctttaaataaataaacaatgctgcaaatagccataaaaaacagcctacataaataagaaaaaaaatgaaacaaacatttaaatttaaaaatatcgaaccccaagaaaaacgatacaaccaagaaaagaaacttgtaaaaccataaaagatcatagttgcaagaatgcacatagcaattgcccatggtttaaacatttttaattttgcctcacataaaacatcttcatcacttgataaatcttccgcatctaaattaacatttcgataaatatgcatatcttgcatacaacaaacatgttcatatcctaaatggtctaaagtttctaaatagtcatccgttaatggattataatcgacttgatatttataaacttgtgaggatttttcaaacttaaaaaatgaattaactgatacaagattccatccttttttagacattctatctagataaggaattaatatttcatcataaaacaatctattttttaaaaatgtatacttatatttcatcttcataatcctttttcataaacaaaataatttgtttttgcatcctttccttttctaattcaagtctttcttttcctttttgagtaattatgtatatttttcttttattttcttcttttaataattgaatatatcctatattttcaaaacgtggcaacaatgcataaagtgttccagcaccaactctaacatcaccttccgtcatttcatttactttttccataatttctaaaccacatatgggctcatataatgaaagtaaaatataaaacatttgtggagttaatgtttcaaattcttttctcgccattttctcacctcttttatcgaatatcgataaatatttcaatcccattatatcgatattcgataataaaagcaatataaaagcggacttttgcccgcttaatttctaacatatgctttaataacttttattgtttcatcatttaaaggtctaattgtatattctttaacatttgcaggaacaataaatgtttctgcataatgtactgtataaggttcaaattcattttaggactttcaataaagaaacctctctttatcttctttaaaacatcttcatcatcattatcttgtttaaaattaggcgtacattttcgatatctcaattgaattttccaacgagcaagatcacaataaatcaaagtatcacctttatgaatgtaactcgctctaacaccataaatcaaagccctgactttatgactagcaagtaattaatattgagccaattttatatcatcaataaaatcatccatctttccataatacatgactcctcttacacgattctctgttaaaaaaggcttcatcattttattaagctcatatttttcataaaatacatcttcacttttaatcacgaaatcaggtttataaatttctttaattaaatcaaagatttcgtcatcgacgccaggataacaatctacagttaaacaataattttcttcttgtcctagattttctaaatattttttatttctgttttgtctgtacaagcttcattttcatatccacttatatttatttctggaaatttatcataattcattactatcacctaaattcctttacacttgttattttatatttaaattatatcccatatcatcatatgaatctacaaatctcaaaacatattattcccctaacataataacaatcgtatctccttcttcaacatactcaccttttcttggtaattgatcaatgaccttatttcctttaccaacaaaagtaaaacgtaaagaaatattttgaacttcacttctttttttaccgatataattttctactttgattgttcttttatccattatagaatatgatttttgtctttgagattttacttttttgacatttaaagcaggtaaaatatcaacaaacatctttctagcgataggagcaactgttgttccaccatattgaatacagtttttaggattatccattgccacatacaaaacaatttgtggatcatcaataggagcaacgccaacaaaagagagaatataaccacttccaacatagcttccattaaccgccttttgcgccgttcctgttttaccaccaatacgataaccgtttatataagcatttctacctccaccatcagtcacgacactttctagcgcatctcttacttttttagatgtttcttctttaataacctgtctttttactttctttttaacttgttcaacaatttcattatttgaactgttactgatttcttttaaaatatgcggttgcaacaaatagccaccattgacacaagcacaaatagcagttaccaattgtaagggcgttacagatatgccttgtccaaaagcaacggtcgcttgttcaagttcatgaaagtttttataatcaaacataatcccacatgattctccaggtaaatcaattcccgttttttcagttaagccaaaattttgaacatattgatacaatctcttttttcctaatctcctaccaatttctacaaatcctggattggatgaattttgtaaaacttctctaaaagtctgtagtccatgccctccttttttccatgatttgattcttgcacctgaaacatattcataccctttatcataataagtatctttatccatatcaaataaattttcatttaaagcacttgaaaaagttatgattttaaaggttgatcctggttcataagttttccaaattggaatattttgattataaatatctttatcctcattttgataatcattaggattaaagttaggataactggcgattcctaaaatctctccatttttaggattcatcgctagtgcccaaataccatctggatgatacgtatcataagcatttgataattctctttcaaggacatcttgaattcttttatctatggtcaaagtgatattcattccactttgactatacgtataatgacttggatacatttttaaattatgacttttagcatccatataataatcaatcgaaccgttttttccttttaaaaacgaatcatattctaactccaatcctaataatccttgattatcaattccaacaaagcctaaacaatgacttaaataattatttcccggataatatctttttgtatctttaatcaaataaacacctgataaatgcaatctttgtattttacttgcaacttgattatcaagttgtcttccttctggagaaattctttgaatcgacacatttttatttaatttttctttcaaaacattgacatctacatttaaaattttacttaattctaaagctgttgttgcttgatcctttatttgactcggtacaacaaccaaagaagccgttgtaagatctgttgccagtacatttccacttcgatcatatattttccctctattagcttgtacaggaaaagacctttgccaagactctaatgctttatcataaatatttttacgatcaatgatttgaatataccccactttaaaaataagcgctaaaacaatgagataaatacatattttaatgattttgatcttattaacagattgttgaaacaacataaatctcaccattataaactatgaaaaaaaagaggaatcattcctcttttaagatattactacagttaaactatcaccgctatgaacaactgtattctcgccaacactttgagcagttacatgtccacttgtgccatcaatcgttaattgaataccagcaagtgaagcataagtttgtacttcttttttagaccatcctattaaattaggaagtgttatatcttttccttctgttttgataaatactttatcaccacttgtcactttgcttttagcaagtggatattgttcaataacagaacttccattaccgataatttgaacacttaatgattttgattctaatttagattttacataattaacagattgatttgtataggaatctaaagtatagctttgatcaactgctgtcgtatttttagcattatagcgatttactacttgaagtgcttcattcattgtttgtttaacaatatttggcatatattgagcatatgaatctcctgatttaaaagttaaaaacatcacgacttgaggatcatcataaggagcaatccctacaaatgaatgcatatataaagttgtactataaccaccattttcaacaacttgtcctgtccctgttttaccaatcatacgaacatcattatctaaacgataagtcttccctgtcccttgttcatcttcaataacacctaacattaaatcttttacttgactgattgtatttgttgaaaagatttgttttgaatatttcggtgttgcttgatagacaactttatttgttttaggattgacaactttatctacaatatgtggttgaaccgttttcccatcatttccaaaaacactatatgcttttaaaagttgataaggagtgaccgtagaaccttgaccaaatcctgtcgttaaatattcaagtcttccagcattttttcttgtataagcattgattgatgatgaacatgtaagtccatccactgtatcaccttggaaaaagcctaaatcatttaatttctctgttaaaacatcttttgtaacataaccttgatccaataaattacaaatagctacgttacttgaatgatacaatccttgatcataagtaattgtaccccaaccttgaccaccattatgatctttaattgtagcaactaatttatttccataataaacattataacttcctgaattataataagcattatgatcatatttaccttcttcaatagaatcagcataaataaatggtttaaaaacagatccacattcaattgttccttctaaaaaataattgttgaatgttgatatatttctttcattaggattaaaagatggataggttgacattgctagaatctttcctgttttaatttccatcactccagcagtcacaacttcagcaccactttcactataagcattagacatcaaataatctaaatttctttgaagaccactatcaatcgttaaataaaggtcatttccattggttggatctttctctcttaaagttccatctactaaagcatatccattagcgtctgtttgataaaccttataaccatttttaccttttaattgtttatcataagaaagttcaagtcccatttctccaaccattttcttaacactttgatcattataactttttgcataccctacaacatagctacaaaaatcacccaatggataatatctcgaattagactctacaaactctattcccgtaagattacaatcttctatttgtttttttactgacgctgataaattatttccttttgtcccaagttcaatttgataacgtccttcatcctttgctgtttgtaatttagatgttaattcattgacatctattcctaaaataggacctagttgactagctgttttattaacatctttaacataagcaagttttttaccatagcctgttctttgagatgaaagcaccaaaataattttatactttttaacattaatagctacattttcatggtcacttgtataaatttgccctctttgagcatattcaacaacttctttcttacttctatttttcgcaaaagaggcaatgttctctccactgatcaagtgttttcccgttgcccccaagtataaaatattaactaccaatgaaaaaataagaactgcaaaaataatacccgttacctttgcacttttgtatttcttcattattgctgagctcctgttgttgatgctgttgcatcattttgataagtatatcctttagaagttgcaacttcagcaacacgattgaatgaaactaattcttgtttttgcatttgtaaactatctatatctgattcaagtgtgtctatttcattttgtaatttttgaatggttctattatatgaagattcaactgatttaaccataataattccaaaaacaaaaacaacaattgttacaattaaaaacacttgtgcaaaagattcaaatcctgtctttctctttttcataaaataaccctctctataactcttaatttagctgaatgtgcacgatgattatgagttaattcatcatccgatgctataatcggttttctattaaccaatttaaatttaggttgcatttctaaaggaataactggtaatcctttaggaacatcttttaattttgaaacttcattaaatgtatatttacatattttatcttctaaactatggaaagtaataaccgagattcttccatttaaatttaaaagatccaatgcatcttttaaagcaatatcaaaaacatttaattcatcattaaccgcaattcgaagtgcttgaaaagtacgttttgctggatgtccaccttttcttctagcataagcaggaattgcttctttaataatatctacaagttgaaaagttgtatcaataggatgtatttctctttccttttcaatttttcgagcaatctgttttgcaaatttttcatccgcatatttatataaaatttctacaagttgttcataactataatgattaacaatataatgtgcatccaaagatgcctcttggttcattctcatatctaatcgagcatcatagttataactaaaacctcgagccccatcatcaaattgaggtgatgaaacacccaaatcaaataaaattccatctacatgttctacaccacgaagatggagttcactttttaaattcttaaaattggattggataattgtaaattgattaccaattttctccaacctttctcttgcagcttcaatcgcatgaatatcttgatcaaaacaatataaatggccggttgttaactgttttaaaatcaaacttgaatgaccagctcctccaagtgtacagtctacatagataccatctggtttgacattcaatccttcaactgcttcatttaataaaactgtaacatggttgaacattcaaaatcctcctataaactaaaatcatctaaagattctaaaatatcatcataactatcctgattgtcattatagtattgattccatttttcttgtgaccatatttcaccatggtttcctgccccaataatgacacattctttttctaagtgtgctaaagtgcgtaaatttgtaggaatgttaattcttcctaatttatcaaattcgcactcacatgcacttgaaatggtaaaacgaattgcttttcgaacttcttttttattagaaggtaaagaaaggagtttcgcacaaaacggatcccattcttcttttgtataaaaagcaaggcatccatcaaatccacgggcaacataaacagaaccttgacattgattcctaattttagatggaatcgtcaaacgtccttttgcatcaatcgaatgcttaaattcacccatgaacatcactatcacccactttttaccacttttatattcacttttaccactttataccaccattatatactttttaaatcacttgttcaataaatagatgtgaataaaatatagaagttcacatttcttgtgaactaaaaaaggtaaaaaaaaatcaccctttggggtgatcttcttattttacttttacacctttgtaagttccacaatgtttacaaactctatgagacattttgtattctccacattctggacatacaactaaagttggtgcagataatttatcatgtgttcttcttttatttcttcttgtactagaaactcttctaaatggtactgccatctttatatcctcctattgtttaaaataatctttcaattttgctaaccttggatcaatgtattcttcatcattatcctcttgaccatcgagtatcttccaacccttacctgattccttgatgttagcatcatcttttacgaccctcataggcacttctaacatgatatttgaaaatacgacaggcgtaaaatcaacaacatctttctttgcttcatgaacgtcttcaagcggatcaggcttttcaaatgaaaatacttccgtcgaatcgatatcaaatggataatcaacatcttccaacgttaacgcacacggaagaatcattgttcccttaatatttaaatcaacatataatcgtttatctcttgtatcaagattcccggtacctgagacgatgacgtctttaaggccgttaatatgggcatacttttcaaacatttcacatggaaaagttatttcttcttcaaaatcaaatgttcctttgtgtttaataatccactgcaaactatacttcatattaatcacctttccataaccgcaaaatctattatatagaaactcacatcataagtcaatctaaaaatggcctaaaacaacatttttcactttttaatgaagttcttctccattataacaaaaactttaactaaatcaacactattttaaatcattttttcaacatcatttaaaacatctttattttgcataattttaatcaatttatcaatctttctttgatctaaagattgatttgttacttttgcaaccgtttgaataaaatctctcatatctttttcattattcaaatctttcttttgtaaatcgtttgctaatttaaaaatatcttcttttttcacatttgtttttttagatacgcgatctacaagtaaatctttatctttcataatatcaccactatatactatgaaaaaaataaataaatgttaaaaaaagagacttagtctctttttctacaaatgatatgaattggtgttccttcaaacccaaatgcttctcttaatctattttctaagtaacgtttataactaaagtgtaaatattgtggatcatttgaaaataaaacaaatgtcggtgggcaaaccgccacttgattagcatagaagatttttaatcttccaccattaaatgtcgttgttggattcattaattgtgcatccactaaaacatcatttaaaacgctcgtttgcactcgttttcttgaattttcataagattcttgaattaatgggaaaatttgatccactctttgacctgttttagctgaagtaaaaacaatacgtgcataatctaaatatttaaattgttcatagatttctttttgtttcttttgcattgttttttcatctttatcaactaggtcccatttattataaacaatgacaacgcctttacctgcttcatgggcatatccagcaacatgcttatcttgttctctaattcctgtttcaccatcaatgacaacaagaataacatcacttttttcaattgatgtcaaagctcttaaaattgaatatttttcaatattttcataaactttacctttttttctcattcccgctgtatctacaacacgatatttttgtccatctttcacaaaaggtgtatcaatggcatcacgtgttgttccttcaatattagaaacaataacacgttcttcccctaaaatagcatttgtaagagatgatttgccaacatttggtcttccaataattgaaaaactgatttcatcttcattagtttcttcatcttgtaaatctaattgattaataatttgatctaataaatctccaattccaatcccatgtgaaccagaaacaggaataggatcaccaacacctaatgcataaaattcatatatataatctctaaattgattatcatcaattttattaacaactaaaataattggttttcttgatttttgtaaaagacgcgctacatactcatcttctttagtaataccttctcgaccattaacaacaaatacaataacatctgcttcttcaattgcaatttctgcttgcattttaatttgtgttgtaaaagaagcattttctaattcaatacctcctgtatcaattacactaaactcttttgtaagccatgaagctttagcatagatacggtctcttgttacacctgcaacatcttcaacaattgaaattctttctccaaccatacggttaaagattgttgattttccaacattagcacgaccaacaattgcaactacacctgccatattattcctcccttgttttattaattaaagttaacacttgatcaacaacttcttctaacgtcatattcgacgtgtcaagttcaattgcatcatccgcttttttaagtggcgaaatagcacgatgcatatcttgataatctctttgttcaatttcttttttgattgtttctaaatcagcctctaagcctctttctttattttctaaataacgtctcttcgcacgtgtttctacacttgctatttgataaatttttaaatctgcatgtggtaaaacaactgttccaatatctcttccgtctaaaataacattcccagtttcagccatttttctttgctcatcaactaaaaatgttcttaccgcttgatatttagaaacacagctagctccaagtgaaacttcatctgttctaatttgaaggctaacatcttcatcgtttaaataaactttattatcagctgtaagacgtatttgaatatttgaaattgcttgttcaacagcttgttcatcatttaagtcaatgtgattttttatacaataaaatgcaacagatcgatacattgcacccgtatcaatataaatgaaattttcctttttagcaaccatttttgcaattgtactttttcctgcagcactaggcccatctattgcaattgaaatttttttcttcataaaataaacaccctcctaaaaaactaaggtcttccttagttaaaaaaaactttgatataagataactccaagtaaagcaatgaaaataatgactaaaataacaataatgacattcatgatcttaacagctttactttcacctttattttcaataatctcttcatcttcaataaaagtatcattttcttcaatatcttctactggattttcttctatcgtttcaacgatttctttcgtctctgtgatttcttcagcttgtttttcttctgcttcttcagattcttgttgtaaaaattcttctgcttttttcacatcttcttctggtgacatcgcagctaatttttccataaaagtcattttttcttttgactcttcttcaacttcattatttacaaacattcctttagcaaattcttgtgtagcatagctttcaactgaatctatcttaattgtatttttttcaggttctctaattttacttaaaatatccattcttgtattatattgatcttgtttaccaacactttctttcgcacttttaagagctttatcaagttcagctgagccttcttctctcatttgttcaaatgttttagtttctgttaaagtatcttctaaatttacttctttttcttctttatcctttttcataaatgacaaaaaatcatcatcgtcatcatcattttgaactggttctacatacttttctttagaaatgccaacttcttccttaagtccatctcttaattcttggtatttttttactcttgaatacgtcattttcccaccatccctcgccattataacataataatcactataaaaaaataaaagaagcctaagcttctttaatatatttacttttaaatcttttttcaaccggtcttacaagataataaacaattcctgtaataattcctttaataaaattaaaaggaaaataaataataaaaatagcttgtccataaggtgataaaaaagataaaaatttcggaattgaaatatttgaaccatattgttgattaaatgcctgaatatctacagtaaaaggcatttgtgtataccatgtcggtttttgcattaaataagtaggtgtcacaaagaaataattgatgacaaacataataaaagcaaaaacaagcatcgttaaaaccatatctaaaaaataattctttaaattcttttctggatcaattttttgagcaagcaatgaatatgttacacaaattgataacgatgcaatcaatgctgcaatttgcccaatagctattggtcctacaggtcctttaaacaaaatagaaacaacaaatttacaaatacagacaaacaacgctggtataaatcctaaagtagaaattgctacaagaacaacaatttctgataaatcaagatttaaccaaggagcaaagggataaggaatctcaatgagatttaaaatcatcccaagtgcagccagcattgctgctaaaaccattttttgtgtcttagtactttccataataattctcctttaaaataaaaaatatcatgaaaatactaatctccatgactaaaaacattatctaaaaaaatgtctttcttccatctagactctcactatcggtaaaggaattgcaccttttctgcatctgctcgtggactatcaccaccggtcgggaatttcaccctgccctgaagactttcttttcttatatatattagcacttcaaaaaaaagaaatcaaatcatatgatttctttaatcgtaaggtttatattcaactgttttctttttaaaatcaataagcaattgaaaagcctttcgatcttcatcttcatcccaaatttccacaaactcaggagtcacttctattaaaatttcactatcaacgtgagaataagcattataactttgccataaatactctttatatttcttttcaaaaactcttcctggttcatcaacgaccaatcctttattaacagcaatcccttcaacttgtgttccattaaaacacattgcaacacgattatttttaaacaactgctgtgtctttctaaagttcttatctgtcttaaaatagattttatcattataaaaaagacaactgacatttctcaccatcggataattatcctcgcaactagcaagtgccataattttccaatctcccattttttgtttcatgatttctttagcttctaaaaattccatcttatttcctccctatataattccttgatatcctaaaacaaacaaaatcattgtcactaaaacaacacctacgacaaagacataacctttataaacacttccttgttgatcagatttctccactaaatgacttcttcttaatatttgaaccactggtttatataagaaaaagacaatggcagcattcatcgttgctttaattaaattaaaaggtaatattcctggaagcaacattggtacaatagcacttcttggcattccataataaataggtgtaatgatataattccaaataagcatagatattgttgtacacgtaacacctagaacaagtcctaaaacagctcctttttgattatgtacttttttatagacaaaagcagccatacaagcaaaagaacacgttgaaaccatattcatcaagacatctaaaatattgcctccctttaacatgatttcaaaaatcgaacaaataaaactcattaataatgatgtcattggtccataaataaatcccccaataacaattaaaatatccttgggatcataccttaaaaaagataccgctggaacgattggaaatgaaataaatacattaacgatcattgccatggcacaaagcatccctactgttgttattttctttgtactcattttatatacctcctttaacaaagaaaacgcacctaaaataatcttctaggtacgtttttgtatataaaaagtattacaaaaaacacttctttcatccagactataactgttgctactggaatttcaccagttcggccatctttggctcgcggagtttaccgccagtagagaatttcgctctgccctgaagtattattttattgcttctttattatataataatttttcttatttttaaaggtctatcaaaccataatgttttaatgcataggcaataccttcatcatccacaccttttgtcacaaaatcagcaatgctttttaactcatctcccgcatttcccatagctacggcaagagagacatgttgcaacatttgcatgtcatttcccccatcaccaaaagccatcgtatcttttaaatcaagaccataatattctaaaaatttatcaattcctaattgttttgttccacctattggtgaaatatcacaaaaagttggatgccatcttgctgaaatacaatgaggcatatgacttaagatttctttttcttcatttttatcaacaaaacacataatttgataaatcgatttatcaatgacatgactacaatctccagcaggatgatcatcattatgagtaatagcgtgaattgcatcaacacgctcatcacgatagttgaagtattttgtattctcttctgtaaagccacaaggaacttgatgatcttttaaataatctaataaagcttgtagatcttcttttttgattgtatttgaataaataatttgattatttgtataacaatattgtccatttaacgtaatataaccatcaaaaggaaaatcatttaaaacatctaatccatcttttcctcttcctgttgctataaaaagcttgattcccttttcttttaacttatataaagcatcaaatgtagatttaggaatctgatgatttttaaaactaacaagtgttccatcgatatcaaaaaaaattgcttttaccatattatatacctatatctttcatattttttaagcgttctaaatagcgttcaatacgttttaattcttcaccgcttactcttttagcagaataataatattcaacagaactttccaaattttctaattcaatatttttcattaaataattaattgttcctctattaccatctaataaatggacatgcggtaataattgatgaaaactatctttaaaataattaaaatgtgtacatcctaaaacaagagaaccatactctttaaaatcaaatttcgaaagtgcctcttttaaataagcaagtacttcatcactattaaactcttgtttttcagcaaagcggacaagttttggtaaagcaaccaaatcaactaaatgatctttatcaactctttctaccaagtccaacatctttttacctttaactgtaattggtgtcgcacacaccaataccttttgatttccatataaatcaactgctttttttactgcaggttccattccaatgataggaatatcatatttttttctcattaaagcaactgctgcactggttgctgtattacaagcaatgacaatggccttacaatcatgatcaatcataaattgaataatttcatctacatagccaatgatctcttctcttgttttttccccataaggaacatgtttttcatcagcataatatataaattgttcatgaggtaaaagttgcattgcttcatataatactgataagccacctattcctgaatcaaaaatacctattttcatataattcctctttcaatcattctacattaattataaaaaaagatattgcgttaagcaatatctatttttcttgaagcgtaacttcaattgttttttctgtgccactacgattaacaacaacttttactttatctcctgctttatgcgagtaaagtgctgttaagaacgatttataagtagtaatatctttaccatctaatttaacaataacatcaccttgttggattccagctttacttgcagcaccatcacttgttagtttaacaacatagataccttcatcaacagatactttaacaccatatctttgaagttcatatgaagaataatcatttaaagaaacacctgaaataccgataactggatgagatactttaccatttgtacgaatttgttctgcaactgtcataacatcattaataggaatcgcaaatcccataccttcaacgctttcatcagagaacttcatgttcgtaatacctacaagttcacctttcatattaacaagcgctccaccactattacctgggttgatagctgcatctgtttggataacattcatatcccaatcatcaactttatcatcatttaaatcaacagaaactgtacgatctgttgctgaaacaataccttgagtaacagttcctgaatattgaattcctaatggtgaaccaatcgctaaaactgtttctcctttatctaataaattagaatctcctaaatcaataacacttacatcaaagcttggttgacatcttaaaatagcgacatcactatattcatcactacctacaacttctgcatctacatattcattatttgaaaatacaacttgtactttgtttgcaccatcaataacatggtggttcgtaataatataggtatatttaccagttttatcataaacgaccccactaccacttccagattgtgtttcactcgaagaatttgaattatcaccaaatccaaaagcattatttgttgtatttttataaacaacaactcctacaacactatcactcgctttttctacaacacttgttgtatctgttttaacatcataattgacttgttttacagttcctttatttgtaacggtcgttgtactatcacttgatgatgacatcatattataaaaaacatagccattcattgcaaaggaacagacaatagcaactactaataaaatttttactatttttttccatttcttttctttaggtttatcttcatcaactaatataaaattatttttattatcttcgttcataatatttcctccttttgatgctattatcataaataataaatatgtctaaattatatcctcattgtgggaaactttgggatttataggcaacttgacagtaaaagtcgaacctagccctaaagtactttcaacatcgatcgttccttgattcaattcgacgatttttttaacaatacttaaaccaagtcccgttgatatctttgaacttcttgatttatctacttgataaaaacgatcataaatataattcagcttatttttaggtatacccattccttcatcttgtacacttaaaacaaacatattattttcttttttagttttaattgtaataacaccatcattagagtatttaattgcattagaaataaaattacttaaaattgttttaaccgttgaataatctaaaataacaggtttttctattttattatgataaataagagaaatatgtttttctttagccattggctcaaataaatcaatactttctttgacaacagctttgacatctaattctttaaaatccaatttaactcttgtttgatctaatcgtgataattctaaaatatcattaatgatattttgcatacgataactttctttcaacaagatatccataaactcttgaaatatttctggtgaatctaaaccatccctttttaatatttctacacttccaataatagctgacatcggtgttttaagttcatgagaaacatctgataaaaattgtttttgcatatcttcaatttctttcattttagaaacgtctgtaaataaaacaatcgttccatcaaaaataagatgttctttatcagaaaaaacaggtgaagattctacttgataatatctcgactgtatttttacaaccgacgataatggtctttcaaaaacatagcattgatctactaaatcaagcatctcacctacaaatatatctttataatatcttccttttaaatgtggtatttcaaagccttttctaaaactttgattggtaaaagctattttcccttctttatcaataaataacatcggtaaattcattgatcgaatcaattgacttaatatcttttcatgatatttattttcaatttctacttcctttatttcattatccttttctctttgaaaaaaacgtcccattcgttgataatgactttctaattgataagcattgattgcacatacaaagataaaaagaagcataatataaagactgtaagccttattaaaataacaaagtaataaagtaacaactcccatcaatacaactttcaaataacttttagtcatcttttttcaccaacttatatccaactccccttacagatttaaaagaaactcgactttcttttaactttccttttaatttaaaaacatgaacatcaacaatacgtgtatctccatcatattgaaatccccatatagactgtaataaagtttctcgagaaacagcttctttaggatgttccataaacatttttaataaatcatattctacttttgttagaacaataacatgatcatcaattgtcacttctcgatttttagtattcatcataacatcttcaaatttaatttcatctaaaaaatgtttatgatgtcttcttaaatgagcttcaattcgcgctattaaaactgctgattgaaatggttttgttaaataatcatctgctcctgcttctaatcctttaataatatcttcttgttcactgcgtgccgttaataaaataagtggtttaacataatcattttgtcttacttctttaataatagagacaccatctttatatggaagcatccaatcaatcaaaacaagatcataatcattttctaaaatcttcgaaacagcctcttttccatcatataaactatctactaaataacctttttttctaagttcataggcaagtatcttattgatggacatatcatcttcaattaataatatattattcattattcccatcgtatctttctattattctttgaacaacagggtgtcttacgacatccatcgctgataaatgaataaatgaaatccctttaaccccttctaaaatatctaatgcacgaataagtccagaagttgtatttcttggtaaatcgatttgtgaaatatctcctgttacaatcatttttgatctgaatcctaaacgtgttaaaaacattttcatttgattatctgttgtattttgcgcttcatctaaaataacataagcatcttctaaagtacgacctctcatataagcaagaggtgcaatttcaataacacctttttccataagcttttcagtttgttcaacacctaacatatcgtataaagcatcatataaagggcgtaaataaggatctactttttcttttaaatctcctggtaaaaatcccaaattttctcctgcctcaacagctggtcttgttaaaattattttttttacttcattattttttaaagctgctactgcaaaaacaacagctaaataagtttttcctgttcccgcaggtcctatcccaaaaaccacatcgttattttttaaagcataataataactcttttgtcctaatgttttaggataaataagttttccattatatgttctagctatttttatatgataaagttcagataattgatccaacttatctttttctacaagtttttgagcatagataacatctcttcttgaaatagaaacccctgaaacaatcagttttaacaaagaataaatgacttttttagttttttcaatttgttgttgacttccaacaattgacatttcatctcctcttaaagaaatttcaacttgaaaatgatcttctaaaacttctaaattttcatcttttactccagataaattaacaagttgttcaatgttataagcttctaacttaacaatttctttcatgaatcctccctaattgcaatattctctataaaaacatattgcatctttaatacatatttcttctctattatatcatatgatagtactttttccctgtcaatttttacatcctttggtaattgacttcttattttaaaaagcaaatacgcaaatatatctttatctttaacatttgatgatgaagcctctatatattgataagtataagcttctacacttcctaaagtgggaatcatttttatttgttgtttcgtatcttcaatttgatgtgaaatcaaaacatctcctttttttacatactgattcactttaactaaaacatttccttgtttgacatccaattgacgaataatcccatcttttttagcgatataatcttgatattttaagaccgtcttttgattatgactagcgggtgtatattcaacatgtaaaacacttcccttttgataaacatttaaataatcaattttgctttgatattttctttttaaatgatcataaagtttattgatttgaggataagtcaatttaggatgcatcatttgtatttgtttattgaagtctttttgaagttgattgttcacgatagaaagagagcctgttattttatagtcataaatatagtgtggtaaaataaaaagtgtgcttataaaagcgagtgtaaaaatgatttgtggaaatttaaagataagaaataaataatgaagtagtcctatacttttttgaatgggtaaatgcatagaagatgtgatatatctttgataaataggaacgtaaaatgaataacgtaatgcatcaagttgatgtaaatgaaaaagtgtgagctgatgttttttggtttcttttaaaaatgaaacaatatcatttgtttcaataacaatataatcatagcctaaattcatgaaaatataattgatgtaaactcacccattaacataatttcatcttgactatagtaacgtatttcaatattttttccttttattgaaataatttgttgattcattttacattcaaaaatcgttgattctaatgtaataatcaactgataatgtttaattaaaattctatttttttgtatacaaagcattctatcacctattataagctatgatatttccttttcattatgtatagaattttatgatccaatctttttataacatcaaaaaagtcaacttgtaatgttgactttacttattttgatcttttcttcttaataattcatttcgataaacaacgagatctttataaatatcacttaatgttgaaaaaacccattctactctttcatcaggaatacgatttctataaatagagtctaattcatgatgaaattgttcatgaactttcaaagcttcttttccttgatttgttaatcttaagtaataaatacgttgatcttgagtagatttttctttaataagaaaacctttttctacaatttttttaacagctgtcgtaagagttccaagtgttacattcaaatgatttgcaacagctgacattgaaggacttgattctttatcaacagcttctaaaacatgcatttcagacatcgaaagttgtttaaaaggtccttgttttaaatataattcctgtatatccatcgcaatattaaaaacatcaacaactgtttctatcgtatctactctttgtgtcatctttttctccttattacccttcgtattttctaatatattgataaccaataccaccaatacccatatgagctccaaccacagctggtaattctcttacaagtatttcacattctccaatttgttcaatcaatttttgtttcatttctaatgctagatcttcacttaaaacatgttcgattgcaaaaacataattcttattgttaaccttacattcattgaccatgtgatcaataatttttaaatttgcttttttagctgttcttactttaccaaaactatcaattttaccacctaaactatagtttaatttcataattggtacaatttttaaaagtccagctaacgctgcaacagcaggagtaatacgtcctcccttttttaaatgatctaaattaggaaccataataatcgttgctgaatcttctacaagtttttctagaatctcttttatttcttctggtgattttccctcacgagcaagctttgctgcaacttctacaagatatttttgattacttgctgttccttttgtatccactaatgttactggcatttctaacatatcacacgcaagcttcattccattcatggttgaagaaagtcctgtagcgataggtaaaccaataacatgactatatccttgatctttgattttttgaactgcttcttgcagtgaacctgttgatggttgagaagtcatcaccataatatcgtctttttccatacgttcaaaaacatctatactatgaatttcaatatcatctaaataacttttaccttccatagtgattgttagtggtgcaataaatattccttcattttctcttgaacctacagaaatttgacatccactatccgctaatatagcaattttttccatactctccacctcttcctcatataatataacaaattatggattatttttaaagttttatgttatcataaaagtcggaaggtgaaaaaatgaaatctattgaggaaataactgaacacacattagtcattaaaaaatcagagtttatttgtacgctcattcctttaaatgatgaagaaaaaatcaatgaaactattgattattataaagaaaaatatgaagatgctacacataattgtgttgcctatcttgtaggtacaaaagaaagagccaatgatgatggagaaccatcaggtactgcaggtcttccaatgctcaatgttttaaaaaaacaagaactcagtaatattattgcaattgttacaagatattttggaggcattaaattaggggctggaggtttaacacgcgcctatagtcaagctgtggctgatgctttaaaagaagctaatattgttgaaaaacatttaatcgatgtctatgatgtttctcttgattatagttttactaaaaaatttgagcatctattaaaagtaaatgacattgattgtataaataaagaatacgatgaacaagtcacttatcgtctttatattgatgatttatctttctttgatacgattcaagatttaacaagtaatcgttacagtaaagaatttataaaaaaagaatatgttcctgtaaaataaatatgtatttagcctgttgacaaaataatttgttgacaggcttttattgtataaaaaacaattattcattggactatccgtccattgaaagaaggaaaaaggaaagataacatctgacttttaatcagagggtcaggcgttcgagtcgcctgcgggtcaccatttcaatgcgggcgtggcggaactggcagacgcactagacttaggatctagcgccttcggcgtgcaggttcgattcctgtcgcccgcaccaaatgtaagagacatcgagaaatcgatgtttttttgttttatatagaacatttatgctataatcaaataaatagggaggtgaaacaatgaaacaatatgtaacatttaaaatcaaaaagatttacctatatatccttttatttgttttagtgattactctttgtggttttggctattataaatggtgtgctagtcatcctgaaatcaatattcaggtaagtgaaagcacagccgggaataatttaaaaatagaagcaccacaaataatttatactacacgacatggtattgaaatggctcctgaaatagaattacaaattgtggaaattcagtttcaacatgaaggaatatgttcacttttaaaagaagcttatcaaggcagtgatattcaacttgatttatctgtaaaaaatggaaaaacaatcatgcactattatggaaaagccacgacatttgcaggtaaagaagaaaattatgatattgaaacaaaacttgattttgcgataaatgctaaaattaaataataataaaaaaatagctttttgtaatgaacgacattacagaaagctattttagttttctaattgacttgtacagtgtgggcaacgagatgctttaatagaaatttcactttgacaataaggacaaatcttctttgttggtttttcttctactggtttttcagttttaaatcttaacttgttcattgctttaacaatcataaagatgacaaaagccataataatgaagttaagtaaaccagtaataaataaaccataattgacagtagatgcccctgctgcttgagcagcagctaatgttttgtatgtatttccatctaaagcaataaatagattagaaaaatcgatcttacctgtaactaaacttaaaataggcataatgatgttttctacaagagaagtgactaatgaattaaaagcaccaccgataataaccccaacagctaaatcaatcatgttgccttttaaggcaaattctttgaattcttttaacattatattgatctcctttttctttattataagaaaaagaaaaaagacatcaagatgccttttatgttattcttatttgggaggataagaataatatagaaagataatagagggaatatgaatagtaaaatctattttctttctacagatttaatatatgaataaaaaatagttaaaaaaagttacaaatgtaaaaaaatatgtgatttgttatcacaaatttatataagcataaagatgaatttagtgtataatattgtagaataggggaggatgacatgaaaaatttattttatagattattaatatatttagatagcgccaatgaaacagatacaaattataacattgcctggtatatggcacatcatatttcagaagtagctcatatgggaatttctaaacttgcgagtgaatgttttgtgtctccggcaaccatttctcgtttttgtagaacacttggttatgaaaattatgcacatttaaaacaagagtgtgcgtggtttagttcaacatcaagaaagtttaataatttaattaatgttcctttagatatgatgaaagatcatccagaagaaagtacagcttattatagccaacaaatttgtacatctttaagtcaactttcttcttatttagattggaatgtaatcgatgaggttttaaaactgattcatgatagtgataacgtagctttttttggaacacagttttcacattcggttgctttacattttcaaactgatttattgatgttagagaagttcacaatggcttatatggaacaaacaagtcagcttcaatgtgctaaggagttagatgaaaatagtgtagctattatcttaacagtaagtggtcatatttttaatgggagtcaaaagatgatttcatatattaaaaaatcaaatgcgaaagttgttgtgattaccaatgataagagctttgattttggttttgaaccaaattatattattgaaataggtgattcaaaatataaaaaaacaggtaaacataatttacttacaacaatggaattaatgtcacttagatattattctatttattatcctgatgtaaaagataatattattgaataggagatatatatgagagaaataacatgttcagcaattacagatgcaattaaaaaaatgtgtatagaagcagcaactattttacctcaagatgttgaaaaagcattatcacaaaaacatgatgaagaagatagtgcacttgcccaaaaaacattacaagtattaatggataatgcaaagttggcacaagaaaaacaaatgcctatttgtcaagatacaggaatggcttttgtttatgtgacaatgggacaagaagtacatattacaggtggcagtttaaatgaagcaattcaagaaggagtaagacaaggatatacagaagggtatttaagaaaatcagttgttaaagatcctttgtttgaacgtactaatacaaaagataatactccagcaattatttattatgatattgttgagggggatacttttcatattactttagcacctaaaggatttggttcagaaaatatgagccaaattaagatgttaaaaccaagtgatggacttcaaggaattaaggattttgtgatgaaagtggtcaatgatgcaggaccaaatgcttgtccaccaatggttattggtgtaggtattggaggttcttttgataaagtgacaatgcttgctaaaaaggccatgattcgtgaaattggaagtcatcattcagatcaaagatatgcttctttagaagatgaattattacaaatgatcaatgaaacaggaattggtcctgctggttatggaggaaagacaacagctctttctttaaatattgaaactttccctacacatattgcaggaatgccagtcgctgttagtatttgttgtcatgtctcacgtcataaggaggtttcgttatgatttatttagaaacaccattaacagttgataaaattaaacagctaaaagctggagatgaagtttttttaagtggaacgatttatacaggaagagatgctgctcataaaagattgattcaattattggatgaaggaaaagaacttcctttcaatatccaagatcaaacgattttttatgttggcccaacaccttcaaaaccaggtcaagtatttggcagtggtggaccaaccacttcaggaagaatggatgcttattcacctagacttattaaacttggcttacatgcgatgattggtaaagggtatcgaagtgatgcagttaaaaaagccattgttgactatcatggcgtttattttggtgctattggtggtgctggagcgatgatgtcttcatgtatagaagaatgtgaagtgattgcttttgatgatttaggaccggaagcaattcgtaagttaaaagttaaaaatatgccattagttgtagtgattgatcatttaggaaatgatttatatgaaattggtagaaaaaactatttaaaaaaggattgtaagtagtatctatattttctataatagcgatacattaatagaggtgaaaaaaagaaatgggattatttaagaaaaaaacagattatagttattacagttcttatagtagttcaagaagacgtttaaaagtaggacgtactgtgattgctgtaattgcagcagtgattgttattttaggaattattatttattttaattttaatagaattcaatttttgatgaaaggttactcttggtcaacaactagtgaattagtaaaatcatttgataatgatgaagaaaaagaattgttatcacatgatgagatgaaacatattttaaaatggatcgataattcaaataaagtagctctttatgatgaatatgaacaattctattctttacataaagaaatgaattatgaagatatcgttgatgttgttaattatatttttgaaaatcaagcgccttcattaaaatcaatgggttatagtgaaaaaacaatttggtcaatgttaaaagatggtgctggtaaaagtgatcttcaatttttaatagacaataaacttacaaatagtcaaacagctccttttagaaaagtaaaaggatatgatttaaagaaaatcaatgattatatagcacaatataatactgttaaagattataattatgccgttaatattgttaattatccatttattgtttcaagtaatggtcaaacaaaagctaaatataatattgctaatccagatgattatttaactcttgtaaaaaaaggattctatttaaatgattatgaaccaaaagatttagtagaattagatagtgaatatgtagcgccaacatgtgatcatccacaacttagaaaagttgcagccgaagctttagttaaaatgatcaaagatgctaaaaaagaaggtatgtatttattattaaacagtggttatcgttcatatgaagaacaagaaaaaatctatcaagaaactgaacaaaaatatggtggtgcttatgctgctgaatatgtagctactccaggagcaagtgaacatcaaacaggacttggtattgatatgacttctcaaagtgtcgttgataaacaaagacttgtctttggggatacaacagaatataaatgggttgttgaaaactgtgcaaaatatggatttattgttcgttttacagaaggaacggatggtattacaggaatttctcatgaaccatggcatttacgttatgtaggtaaaaaagtggctaaggaaattaaagatcaaaactggacgttagaagagtattgtttatataaaaacgttattccaaaatttaagaaagattaaaaatctagagttttctctagatttttatatagagttattatgaaaacattaatcacaacattaaattcaaaatttatccataaatcattagcgttaagacttctttatgtagcttgtaaaaatgatcatgatattgattttaaagaatataccattaaagatgatttaaatcatatcgtagatgatcttttatcaatggatttagatattctttgtttaagtgtctatatttggaatgtggatcatattcaaaaattatgtcatttattaaaggaaagaaaaccagaattaaagattattgttggtggaccagaggttacttatgaaatagatcattttttagatgagtttgaaattgattatattatggctggtgaaggtgaagttgctttaaatcaattattgacagctttggaaaataatgaagaagtcaagcttcaaggtattagtacgaaaaaacatcgagatccacgcttgattccaccagttgatttaagttatttagaaacgttagagtctccttatttattagaaagagacatgaaagatatgaaaaataggatcttatattttgaaacaagtagaggatgtccttatcaatgtcaatattgtttatcttcattagaaaaaggattaagattcttttcaatggattatttaaaacaacaattaaaagcaatcttaaatacagatgtcaaagtaattaagcttttagatcgctcgtttaacgctaaaacagaacatgctttagaaatattagactttgtttttaaaaactgtcatccaggagtacaattacaatttgaaatcaatggggatgttttagatcaaagaattattgattttattaatgaagaagcacctgatggtttacttagatttgaaatcggtattcaatcaacttatgaaccaacaaataaagttgttcaaagatatcaaaactttgaacgtctatgtgatgttattcgacaactccaacaaaatcataaaatagattttcatttagatttaattgcaggattgccactagagaacttacaaagattctcaaaatcatttgatgatgtttttagattatatcctaaggaattacaattagggttcttaaaacttttaagaggaacaagtttaagaaaagaagctaataaatatggttatatttatgaaaaacatgcgccttatgaattaatagagagtcatgatttatctaaagaagatattgaaaaaatacatttagctgaagatatgttacaaaaatattggaattcaggaagaatgccaataacaatgaataaagtcttaaggcaatgtaagtcaccattttatttctttttagatttgggtgaattttaccaagctcaacagtttaaattcattggttttcaattagatgaattattccaatatatcaatctttatttaaaagaacgatatgaagatgaattaatagaagactatttaagattatctaaagtcaaacctaaaaaatggtggaagacaagaattgataacgaaaaagaaatcaaacatcgattaatagaaaagcatcaattaaatcaagaagatatctttagatatgggattgttgaaaaattaaaagaagattatattttagtaatttataaaaattatcaagtccatgtagaaaaatatcatatataatgaaattaaataaaaatttcattatactatatatagataggagactttgtatgattaaaagtattagaaaaagagatgggcgtttagttgactttgaagtagacaagattgctggagcgctttataaagcctttagtgcatgttttgataaagtagaattaaagaaagtatatgctattgctcatgatgtagaaaaaagattagaagaaaaagaaagtactttaccaacagtagaacttgttcaagatacagttgaagaaattttaattgaagaaggctatgtaagagtagcaaaggcttatattttatatcgtgataaaagaagtcgttctcgtgatatgaaatcgattttgttagaaagtattgaaaatgaatccagtgatgatattaatttgtttgatgtttttgaaaacttaatgaatgatgcaatggataaaacaagaaaagaggatttaaaaaagttttttaaacttttaaaagaattgaatattgatgaagaaatcatctatcaaaaagtatcagaaacttttgcaatgacagatgaaacattaaaatcagttataaaataataaaaggaacgaaaagttccttttattattgccaaacttcttcagcgatttctttaacaagtttgactttattccattgttcttctttagtaagtaagtttccttcttctgttgaagcaaaaccacattgtggagacagtgctaattgatttaatggaacatatttttctgcttcatgaatacgtttaataatttcatctttgttttcaagtttagcatctttagaagtcacaagacctaagacaactttttgatttttaatatagcgaagaggttcaaatccaccagcacgttcactatcatattctaagaagaaaccatcaacatgacaattcccaaataaaatttttgcaactggttcatatccgcctgaagtaaaccatgttgatctaaagttacctctacaaatatgcattgtaataaccatatcatcaggtttagcttctaatgcgagattgatcatatcaacatattttttagcaagttcatctacatcaattcctcttgctttgtaagcttctcttttttcttttgaacaaaattctccccatgaagtatcatctaattgaagataacgacaaccagcttgataaaaagctttaatagctttttgataagcataggcgatatcttttaataaaacatcatcatcttgatatctttcaataggttgatagttttcttctctaatacaacaaattaaatgaagcattgaaggagaagggatacattgtttaacttctgtttctccagatgctctttgcatgaatttaaaatgttttaaaaatggatgatcttcgggaaaatcgattttatccacaatttctaaagtttgactttttggttgatgtcctttaaaggcaattgaaaaatgttcgacggctactttttctacgccttttaaatcccatagaaaatctaaatgccaaaaggctcttctaaattcaccatcagtgacagcttttaaaccggctgttttttcttcgtttacaagattttcgatagatttattttcaacttcttctaattgttgaagtgttattttacctaaagcaaattcttctcttgcttgtttaatttctttatctcttaaaaaacttccaacaatatcatatttataaggtgcgttcatttttacttcctccttgttgttactaaaagtataaaaaacataagtggtattgtaaaatacatatttttcattgtttgatatagtttaaaactatatcggctttaaaaaataacaagatttctcttgttatttaataaataagttatttaagtaccaatctttttcttcttgagttaaggcatctttaatatgatcgaaggcatattgttgatattcattaatagaagcaatttcatgatttgataaataatctaaatctagaccagcaatatcaaatggaacataagtgattggttcaaattttaagaaagtaccatattcattttcaatatgttttacacataaaagttcattttcatgtctaataccatgactaccttctacataaacacctggttcatctgttgtaatcatgcctggaacgatacatgcttcatgaccatataagctttttggacgcagtccattaggtccttcatgaacatttaagaaatgaccaacaccatgccctgttccacaacgataatctaaattataatcatagataacaccgcgagctaaaatatctaagttggcgccagttgttacaccttcaataaaatgcgcattttgtaatctaaacatggcttttaaagcaattgtgaaatcttttctttcttctagagtcatttcacctaaaacgaatgttctagtgatatctgttgttcctgttaagtattgtccaccactatcaattaataatagatgtgaagcttctactttagagtattgtttttctgttggatgataatgcattaaagctgcattttcacgatatgcacaaatggttgtaaaggaaatatctttgaaatttggttgttgttttctaaattctaaaagtttattagagatagaaagttcatccatttctatttttccaatatttgtttttaaccaatacataaatttagtaacagcaataccatcatgtaaatgagcatctttagttgctttgatttctgtttcgtttttaattgatttaagtaattgacttgggtttgtttgatcaataatattttcttgacgaatatgacttactaaagcatagttaacagatttagtatctaataatacttttccttcaatatgtttaatatcttcataaatatcaaaataatctttaacttcaatttggtcttttaataattcatcaatgacttcttgacttaccgcttcttttcttaaataaaggtatgctttttctttttcaattaaagcatacgctaaagcaacagggttgcataaaacatcattaccgcgaatattaaagatccaagcaatatcatctaaagttgtcactaaatgatatttcgcatctttcatttcttctctaatgatttctaatttttcttttctagaagcaccacaatattttgtatcatataaataaacttcttcatgggaaagttcaggacgctcttgccaaataagatctacaagatcttcattggcttgaatggtatttgtgaaaagacattgattatagggcattacgcgcccatcaaaaccaatggttgcttctggatatttttcaatatattctttaatagtaggaacacccggtgtacgcattttcattaattgaatacaactaccggcaagttctttttctgcttgaataaaataacgaccgtctgtccataaataagcttcctcttgtcttacgataagagttccagcagaaccgctaaatccagacatataatgacgagcttcaaagtaacttcctacatattcactttgatgaaaatcactggttggaatgatataaagatcgattcctctttctttcataagttgtcttaattttgtaattctttgatttatcataatgacctcctaagttctttcattttaacatttacattcaagaatgaaaaggcttagagatgaataaaaaattaggaatgaatcttgctaaaagtggcatgacgctaaggttttggcggatttatgcaaatgttaaaatttgtctattgacaaatattgaaaagtgggagtagaataacgtgcgaaataaagaataaggtatgtattgcaagcgccacatctctaggaagtgacatgaacaacacaaaaataggggaggtgcttttatttttacatacattctttaaagaggatttttgataaattcttataaattcgtcataaatttatcataaagagtgcttttgaaagctatatctgttgaattttaaaagaatgagagtacaattatcctcgacaagaagaagggggaaaataagatggatgatattattcaaaagttaatagaattcgatcgccaatgcgtagaaaaagtagaacttgcgaaaaagaaaaaagcggaagctcaatcaagtatgatgtcgcaaaagtctacaatttatagtgagtatattgatagtcaacaagatcaagttgaaaagcataaacaagatctattgaataagaataaagaagaagcacaattacaagaaaatgaatttcataaatcaatgaaaaatatggaagatttatttactcaaaataaagataaatgggtagatgaaatctttacaagatgtactaaatagaaggtgtaaagatgtctttatcttcaaatgccttatgtgcaaaagctaaagcaatgtatggtgggcgtttaaataagaatgtttatcttgatttaacaagaaaacaaacaattggagaagttgtttcttatttaaaatctcaaacaagttatgcagatgctttaaaagatattaatattagacatgttcatcgtggtcaaatagaagattgtttaaatcaagaatattatcatcgttgtgcgaagttgatgaaatattcacctaaatctgatgaagatttttatctatttgaaattattggagtagaaattaatttaattatggataaacttgtttctttacaagcaaaggaacaatatagctttaatttatcaattcctacttatttagcgaaaaagacaagttttaatattgatggattagtaaacattgaatcattcaaagatcttttacaatatctttcaaaaacaagatattataaagttcttaaagaaattgatttctctgtcccatttgatgttaaagaagttcatatgtgcttacaatcactttattatgaaaacattgtagaaacaattaaaaaacacttcaaaggaagtgttcaaaaagatttattaaatattctctatacttctattgaattaaagaatatttcaaaaatctatcgttataaacaatatttccatgaatcagaagattcaatcagaagttcactctttttacaatattcaagattgccaaaagatatgatgaatcgtttaattagtgcaagcggtcctaaagaagtattatctttattatcaacttctaaatataacttctatatggatgataaagaatttgcctatatcgaatattatgcagatagtattcaatataatatcgcaaaaagatatatgcgtttttcaaacagtgcaccacttgtttatatgacttatagtattttacaaagaattgaaatagataacttgaagcatattgttgaaggtattcgttataatcaacctgtttcaaaaattgaaaatacattgatctatgcataggaggggaaaaaatgattaagaatacacatttatataacattgttttctctagagatgattatatggaagttttgatgaaacttgaaaatcatcaagattctatttatccagttaaagcgaagaaagtgatttctaatttagatcatgcaacttctatggaagatagaaatccatataacgaagtattagacgaactttataatgtcatggatgttctacatattgaaagggtagatcgacctgttcaaagtgcatttttaaatgttcgtgaaattttagattatatttcagaaattcatcaaaagttagatgatattaatgaaattaaaagaggaattaaaaaagattattatgaaaatcaagaagcgattgaattaatttcatgtttgcatagagatcgtatttctattgatgatattcatgaattaaaatatgttgctttaagatttggtaaattaccattatcacaaattgaaaaaattaaatattttgatagttatccatttgtttatcaagaattatcacatacagatcaatttgcttggattgtttatggtggtgttgaacatagtattggtgaaattgataacattttctcttcaatgaactttgaagaagtaaaacttccaaaatttgcccatggtaaaatggaagaagcagttgctgaattaaaagcagaaaataaaacaatggaagcgtatcttcaagaacttgatcaacgtattgaaaaagtgaaagaagaaaatgaagaacaattacttggtgacttttggaaaacatatcgtttgaaagagttatacaagaaaggtaaatatgtagttgatttaaaaactaaagctgcagtttatgcatttagttcatttaataaaaatgaattagaagctattgtaaatgttcctggaattactattcatgaacttcctattgatacgtatcaagatcaaggaattgaaggtcctgtttatgttgaaaacaacgcatttttccaaccatttgaatgcttatttacatttaaaccaggagaaaagtttgatccaactattttagctggtgtggttatgatgctttcagcacttgttttacttggcgatttaggagtaggtgttttagctattctattatcatttattattaaaggtaacatcagtaagttactacaacgtgtaggagctgctgttacaataggaggactattaagtggaacagtcttctatagtatgtcactttatgattcaatctttgttgtaggtacaaactatgcaatgcaaattggattattctttgctataaatattgtagtattacttgtttgtagtttagtaaaaaaagtgacaaaaagatcaataaagagtaaagggggattgtcatggcaatagcgaaattaaacttggttagccttgattttgataaagacaattgtaatgatgtgttacttgagctttatcaaagagatgattttcatcccgagctagcaagcaagtttacggatagtgttgctggtctttcagcttacaacaatgacaatctttatgaagaattgttatcaagaattgaagaaatgaaaacaaaatatcattttgaagttcctgaagttgaaacagtttgtgagttgtttttctaaaggacttgataaagttcctaatttcactttaagcagttcttttaaagtattgagttttcctttttcaattccttgattttcaaatctttgaaataattgatccattgccttacacatattgatttcatctccttctggtaaatcttctcttctaatatttgtacgtgtaaatgttgccgccatcatgaagctttctgtttcaattttacgattttctcttaatccttcataacttcctgcaaacatactttgactgatttctacgacatcttttaatcttcgattcgtaagctttcttgcatccattgttttaaggtcgataacaggtagtctccaatcattgatataaggttccatctctgatggtatacttttcaatgtttcttttaatgtttctggcaacttccattcttcatctcccgtatagaacacaaagcttcctactggatagacttcttttttactttcaacttgattgatataagtcgttgcatcatagttgagtatgcgaaaaatcatatttttatcaaaagtactttgatgttcaactccgataatcacataatctccatgaatacttgcttttcttaccacatctcgatatcttttgatctctgttggcttctctatatttcctgtcagggttgacagatcattttctctagaaacaagttcttctggtttaatgacctgtcttccttgaaaaaagcataattacagagatcggcaaaacattcctcgtctcttaataactgtttacaggttgtatcacttgcatttcttatttgcctcatttttttacctccttacataagtgttttatagttagtcatcatcgctttttatctcttttttaatatcgatgtaaggagctttcttaatttaattgtatcataggtttaaagataattcgtctcaaatttgtctcatatttgtttcacatttgtctcatttccattatcattttatctttctcttttccttctttcaatggataaatagtccaaaaaaagaagtcccttaggacttcttgaaatacgtttataaagttttatttaatcactcttacattaataattccttcagctgcttcgatacgttcaataatatcttgacgtacatcatcatttgtatcaattaatgtataagcataatccccacgagaacggttcaccatattttctatatttaagttgtgatcagcaaataatttagaaatacgtgccaagatatttggcatatttttattggtaatacatagtcttactcttgattctcttggttgattaacagctgggaaattcacagaatttttaatatttccattttctaagaaatcttttaattcttgaacagccattttcgcacagttatcttcactttcaggagtagaagctcctaagtgaggtaatacaataatattatcttttccaattaattcttgtgaagcaaaatcagttatatatttacttaatttacctgattcaaccgcttctaataaatcctcgtttacaactaaatcccctctagcaaagttcaataaacgtgctccgtctttcattaatgcaaacttttctttatttaacataccctttgtatctttagtacttggtacatggacagtaatatagtcacatgttttaaatatttcatccatatcttttgcttgacgtacatgttttgataaagcccaagcagaattgacagacataaatggatcatatccataaacttccattcctagtttattagctgcatttgcaactaaaactccaatagcacctagaccaatgacccctaattttttaccttcgatttcaggccctacaaagtttgattttcctttttctgctgtctttcctacattttcatcatcctttaaagtattaacccactcaatactttcaacgatcttacgacttgataaaaataaagcacataaaacaagttcttttaccgcattcgcatttgcccccggtgtattaaaaacaacaattcctttttctgaacatttttcaacaggaatgttattgacccccgcaccagctctcgcaatcgctttaacattttttgtaaattcatattcatgtaaagatgcacttctaagtaaaatagcatcttcattttctaacgtttccccatattcataatcttcattaaaataatccaatcctactgaagatattttattcatcaatttaaccttatacatacttgactccttatcgattattttcttcaaattctttcataaatgcgacaagtttttcaacaccttcatatggcattgcattgtaaatagaagcacgaattccccctacagaacgatgaccttttaaatttgtcatgcctgcttcgatactttctttaacaaacttcgcatctaaatctttatttggtgttgtaaaagtcacattcataagtgatctattttctttatcactatgtgctttatagaaagtcgattgatctaaatagtcataaactaatttagctttcttttcatttctttctttcataacttctaatccacctaaagaatcaatccattcaagaacaagtcctaaaacataaattgcataagctggtggtgtgttatacattgaatcatttttgatcatcaatttataatctaataaaacaggtgttgtttgggcaacatcttgaagtaaatcttcacgaataattgctactcctaatccagcaattcccatgttcttttgagcacccgcataaatcatcccatatttacttacatctactggttttgataaaatattagatgacatatccgcaataattggtacgccatttgtttcaggaacatatttccattctgttccataaattgtgttattggcacagatgtgtaagtaagatgcatctttagataaatctaattcatcttgtgttggaatatgtttaaaatcatagctactaccatcataaacaatatgaatatccccatatttttttgcttctgcagctgcttttttactaaaagcacctgtaatcgcataatcagctttcccattctttaaaagatttaaaggaaccattgaaaattgttgagttgctcccccttgaataaaaacaattttataattgtcaggaacattcatcactttctttaataatccttttgttttttcaaagatatctaagtaggaagaggatctatgactcatctccattacagacataccactgccttcataattcaacatttgttttgctgctttttcaagtacagcaacaggcaacattgaaggacctgctgagaaattgtaaactcttttttcggtcatatataaaaccttcctttcttatttgtattgctaacattatattgtatacaattttgtttgtctagtgaaattgtataaaatcatacaatttataatttattatcaaatagataaaaaatataaacaaaaagacagattactctgccttatatatatgccaaacaaaaagaatcatgccaatcattaaagataccattgccacaatcaaataagaatcaatacttatagatgaaataggaatatttaacatcttaatataaaaagattttgatatttcaattaatcctatcatcatataatcaatcaagccttttactaaaagaactattgaaaaaaccaaagaaaaacctgatttatttaaattatataatctaaaaaaacataacaatatccacaataaaataattattctaaaaaatattgattgcataatcgaataaataaaaacaaagatttttgaaaaataacttaacttatttttcatacgatgaatcattttattccaaaactgattttgttttaaaatattcataatttgtttttcttcaatagatatattcaattcatctttgatcatttttttacatgatgtagaaaatttttgtaattctttttgatctaattttattttatttttattggtatttcgcatagattgatcaaaagcatatctatttaattgataaagagcatcactcttttttattttattttgtaactgatttatttgttgaaaatttgcatctgtttcttcgtctataattaaatcaataatttgattgacaataagtgaattaatataattatcactgattgtctttacacaaattgtttgaaatgtcatggaaaccgttagtagacacattaaaacgacaacaacaatacaagtttttaattgtctctttttttgcattaaactcaccttatttttattatacctaataatacaaaaaaagaaactgttctttaaagatgtaaaaaacaatttctatcatgatgattataaatcccaattgcttctaaataagaatagattgtaatacttcctacaaatgacatgccttttttctttaaatccttagaaatttgatctgataacgtactcgttgtttcattctcttttttttcataaataattttatcatttgtataagcccataaatatttagaaaaagaaccatattctttctgtatttcaataaatatttgtgcatttttaactgccgctttaatttttctagaattacgaatgatttttggattattcattaactcatttattttgcaatcatcatacattgctattttattaacatcaaattgatcaaaagcctctttaaaagcttctcttttatgtaaaatagtgatccaagaaagccctgcttgaaatgtttctaataaaaacatttcatacaatttttgatcatcataaacaggttttccccattcatgatcatgataatcaatataaagaggatcatcattgacccatgaacatctatgcatttttaacctttctaaaatcagttaattcaatttgatactctttaagccaatcttttaaccatgatgaacatagaaaatcacattccattgccctaataagcgtaaaagatgaatgtgttagaatatattgatctaaataccctggatggaaaaccatcacggatacatcatgatttctaataaattctaaactgttttcaatatattcttttggatcataaagcatttgttcattaagcttggccattgcaataccataaatattattttctttttcaaactcttgatcaaataaaacattttcataaaaaagaccatattttttagccacatttcttaaagctataaaaaagttttgtgaaataacagcatgacattcaaaataatcaggatcttttccagtgatttctttaaaacgtaaatattgtgcttcaatttccatctcagcttcttcaataactactgtatcttcttttctacttctaatttctcttgatgaacaaaattcaccattttcttgaactaaagatggtataagcttagaatcagttaagggtcttcccacacaaatatttgtatgttgccctaaagcaatatcaaaatctttcacaagttcatacccatggtttgcatgttccatatttgtcatcatcccaacacttgtaataacaccctctttaactgctttataaattcctaaattgactgcttcactaaatcctaaatcatcagctctcataatcaatttcatacttttgtctccttttcctatctttaagataacttttagctttcgcatatgtttttatatttttttctttaattgttctaatatgttgaataacatctttatttaaaacaatacttctttctttatgataaggattaatgataattccatcaagtttatcttgatttaaacacattctagaataatcatcaaaactataaactgaaccttttttatttttacatttttgatctttattcatttctaattgacttgtataaattggataatattttttatcatttatttgataaataggaaaatcttgataatcaaatacagctaaaaaataagctcttgtcgcaagttgttcaaataaaatatctaaataatcatagtgttgacgattaacttgatctaataaaaattgaagataaggattataaacttcttctcttgaagttgctaaatgattatttttattcgtaaagatatacccttgatctatttcttcttgaaaacgttgatcaatcaataatgcataataattttgcttagaatctacttctatccattcttgaatctctactttttcttcataaccataaggacctatcaaaaataaagaatctaatttttgtataattccatcaactattcctaaaacaaacaattcaccatttttatgtttataaattccttcaacacaaaaagaaaagtactcctctttttcaattttactttctttcttaaataatttcatagcatcacaccctttaactattatatttattttatttgtattttacatgaactttagatacgcttttaaaacttttaaatgggcagttgataaaggtaaagcctctatttcctctaaagtatacattccttctatttcatgttctaaaacaaaatgataaacatgcataaaccatgtacgatgactaaaaacatgtttaatatctttaatatgtgcttgaattattaaatcttgatgatacttttcttgaaaagaagaaacaaaactatagggactttcaacatcatattgtacaaaaccataaaaattttctaataatcctcctggtggattttgaataagtaaatatttatcttgataagtgatgattcctgtaatataacttatctcttgtttttttattttttttatattaataggtaaaacatccgtttgtttatttttaaaagctaaacattctttttgaatcggacaacgagaacaaagtggatggacaggtttacaaatcgttgctcctaaatccatcattccttgattaaaagcagaagcatcttgatttaaaatcaattcttgaactatttgatagattttcttttgtacttttgtttctgctatattttctttaagcaaataataacgactgataattcttaaaacattgccatctacagctggaacttgctttccataagcaattgaactaatagcaccggcagtatattctccaattccttttaaagataaaatatcattatattcataaggaaatttcccttgatatttttcaacaattatttgagcactttcatgtaaatgcttcgcacgtcgataatatcctaaaccttcccacattttatagacttcttctaaagaagcactggcaagtgcttcaattgtagaaaagttttctagaaaacgctcataataagggataactgtttctgtcgttgtttgttgtaacataatttcactgatccaaatatgatatggatcttggtcttttctccaaggaaagtctcttttattttgttgataccattgtattaattgtttttgcattcttttcacctttatttattttaaaggatattatttcttttgaaaagaaaaatatggctttcgccatatttaaagtaacattaataatgttccaccaacaagaatcaaaaatccaattaatgatttcttatttaattttaataaaagaccacctttctcatactaagcagacaaaaattgtttttcataagcaagtacagaatttgttatttgtttaaaagtaacaggtgttgacatactaatatactttttcactttatccataattcttttacctgaatatcgatgatttattctccattcttgttcggataagaataatggtaaatcacgttttttaactaatctatataagtgattgatatttgattgaatatttcctgtaaaagtattcaaccactttaatttatgactttcctttgtataatctacaacactgttttctaactgtgctaatttatttaagcaaaaaaatgctttatctctatcacagttgattactatagttgggtcaaacaaacatttttctttgagatattcttcgataggttcacctttatagttcggtaaagtatgaagcttaacatattggggatagttgttatcttctaaagtagacaatattaaaagcgttagttgcttattttcagagtctttcccacgttttcctttatgatgtccaccaatttcaagaatatcgatttcataaaacgagctttgtaaaatcttagaattattactttcagccatcaagattctacattttttactaaatttacgtgcagttttcacattagcatccatgtaattagccaattgatttccattaactccattattggaattaaagaaaacatataagccaataagaattttaagcaaagatagattagaatcctgaaaaatagtattagctaataaagaatgttgatgtccacattttttacaaatgaggagatagccattcttaacattctttcttttgactaagtaataatcatgacaatcacatttatcgcaagacaagccagtaggccattttaaattcaaaaagaaattaatttgtcgatcttcttgaccaaattgattaataaagtcaactaaagaaatttttttaggttttacagtactctagttatatcctcaactttctattttgattacaaatatattgtagaacaaaatagtaaatgaagctgcttattcaactcttttaacacctaaatactgtagttatgagaaaagtggtcttttatttaatattttaatatacaaaaaaatctaacatttgattgttagattatttgataccgtgtgttgtattttcatcataatgatatgtatcaaccatttgatgaacttcttttctaatattactatcttcatcataagccacttgataaagatgatctaattgatcaaagaaatcatgagataactcaataggtttaccaatatgaatcatcttattaggtgttgtttgcataccttcttctttcatcaacatttcttcatataacttttcaccaggtcttagaccgataaatttaatttcaatatctacatctggctctaatcccgataatttaattaagtttttagccatatctaaaatcttaacaggttttcccatatctaagacaaagatttccccaccatgagcatacgctcctgcttgtaatacaagcgaaacagcttcaggaatcgtcataaaataacgaataatatcaggatgagtaatagtaattggccctccattttgaatttgttttttaaataatggaataactgatccattagatcctaatacatttccaaaacgtacagctacaaattctgtttttgatttcttatcaaatgattgaacaatcatttcacataatctttttgaagcacccataatattggttgggttaacagctttatctgttgaaattaaaataaactttttaactccgtattgatctgcagctttagcaacatttaaagttccaaaaacattatttttaattgcttcatgtggtgcatcttccattaaaggtacatgcttatgagctgctgcatgataaacaatatctggatggtaataagcaaataaatcattgatcttattttgatctctaacagaagcaatcattgtttctaaatttaatttaggatatttacgttgtaattctaattgaatatcataagcattattttcataaatatctacaataattaattgtttaggatgactcttagcaatttgtcgacataactcactaccaatagatcctccaccaccagtaaccatgacaactttatcttgaacatatcccataatttcttctaagtttactttaataggatctcttccaagtaaatcttgaacttctacattttttaatttttctaaagtaatttcatcatttaagaattgataaataccaggtaatttttttaatttacatttagtttctttacaaatatttaaaatttcagaaacttctttatcatcaatagaaggtaaagcaatataaatttcatctacatgatatttttcagcttattgcaagatttcatttcttcctccaacaacaggtacattatggattcttcttccttttttagataaatcatcatcaataaaacataccacttctttattgatttttggtgtaactaatgtttctcttaaaatcttttcaccagctgaaccagcaccaataatcatgacacgactttctatatgttctcctctacctaataaatggtgtctagtagcatataatcttaaaaaacgatatccaaatctagctccaccaacaagcataagcaagataagtaaataaaggaacaccgtactaataggtggtgtcaccggacaaatcgtacataaaatacaataaaaaatcgtacttaaaactgatgctataataacatttaataattcattgacagaagcatatctccataaactgtcatataatcttaataagacaaaaaagattaagctacttacaattaaaccacttaataaataataagaatatcgtaaaaagcttaattctatatgaccattataagcaataatagatgataaaaagaaagcaataatgacacttaaaatatcaaaagcaactaagcaagttttttcttattaaaatctgacttcttttttttgtcataaaatttccttccttaatttttgacatttttattttcgctttctaagcagaataataaaacattaactatagtcattataatgtccaaaataaaaataacaataattattttgttctttttactaaacgacattatttgacactcaacgacactatcattcatttttttgtattcaaatactaccatatcaatattcttaatacaattcatttctattgatttttcaaactaattgatagataatatcaattagtattggaggagatttcatgtcttttattgatatacatggtcattatgcttggaatattgatgatggtatgccatcttatgaagatgcaagaaaagctttagagcttgctagagaaaatagaataagtgcaatcgttgctacaccacatgtaactcctggtgttcatactaaagatgatattcatgattttattcaaagaattgatgatttaagaatgctagcaactgaatataatattgatatattagatggctgtgaattatttcttaatcatgattatcaaaaagctctagatcaaaatctttttattcctatcgaaaacacacaatatgtattagtagaatttgatgtacgaaaagaaataggaaatgaacaagaaatagaagaaagattatatgatgtacaatttaaaggttatactcctattattgctcatgttgaaagatattttaaaaatggactagatattgaaagagtaaatggttttattgaaagtggttgtattattcaagtaaatgcttcaagctttttaggatatcatggtaaacaagctaaaaaaatagcttttcaactattagatgaaggcttgatccatgtaattgctacagatacgcatcgagctactggttctcgaaaaccttgtttaaataaaatattttatttacttgaaaaaaatataattatcatgctattcatactttaatgtcagaaaatcctttacatattttaaaaaatgaatggttagaaccggtctatgcaagagaatcattttttaaaaaattagctaaaaaacttaaatctaaataattcaaaaggagtcaacaaagactccttttatttattcctataaaaaattaaaaagtaagcgtcaatttataagcatagaataaaagaagtttaacaacttttattgtttaaacttcttttgtaatttattaaaatacttttttcttttttaagataataattgctagtaatgataccaaacatccgattgtaagtaattcaactggtgtttgatcacctgtttttgtactcttttgagttgtatttttgacaacagtcgtcgtaacattatttgttttattgtttgcatcatcttttttatcagtcgttggtttttgatttgtattgtcgtctttagaattatctactgtaaatgttgtttcaacatttcctaatgtagaagtaattttaatagtatattctccattatctaatgtttttaaatattcttcacttaaaataatgtttactttgttagaaacattttcaattgtatagtattttgtatctaattctttaccattaacaaatacttttaaaacattttctttagaaacattcattgtaattttcaatggttttgaatctttaacatcatatttactattttcaccagcaataatttgtgctctttcttgaacattaattaaagctgttccaactttaccatcaatttctgaatatttaacacttacttcttttgtatcttttgtgattttttcttttggattttcaaatacccaaccttcaggtaatttaattgtatctaatgtatcaccaacgaaaccatttaattctaatccagatttttctaaatctttttcgaaaactctttcttcaactgtaagtaaaacttctcttcttgttcttgcctttgttgtatttcctttttcatatactgtgtaatataaattatatgttcctggttttaatgattttaaggcttcttgatcatctttacctgtacataatagtgatacatgtgtatttccaccaacatttgtgaacattggttcatcattaatagagtaatcaacaacagttccttcatcaacagtaatacctgctaataaatctggcatgtctccttctgtcatcgtaacatctttttcaccactaattttataagcatttgcatagaaagtatccgcatctttttgttgttgttcatttctagcatagcgaacataatctacttcaaattttgttcctgctaagttttcacctgcagcaccaggccaagctccacctaaagccaaattaaattcaatatattgcggtctatcgatacattctaaagctctttgatcatcactataatcaactgttcttacaatttgatcatctacataccattcaatttttccttttgaccaattgattccaaaaacatgataatcatcattaaagataccacttggtaatgtataacaagtaccatgtccagcatactttccatcatcttcaccattagtaccataatgaagtgtttgataaacttgtttattaccattaaccccaccagcagttccattaccaattaattccatgatatctatttcaccactatcgggccatccaataccttgagcaatgttaccatctaaatgaaaatcagaacctaaggtccaaaacgctggaaatactgcttgacctttaggtaatttagctttcatttcaattcttccatataagaattcttgtttaccatgagttcttacacttcctgaatcatagataacttttctcgtagtatctccttgtgttacttcatattgatcttctgtttttctatttgttgctttaataactaaatttccatcttcaagataaacattatctttactatttgtataatgttgttgttctaaacctcttatatgacctaattcataaccccaattctttttatctaattcactttcattaaattcatcagcccatacaagattataattttcatcttcatttgtcacttctgttaaagaaacattatcaacaaatacttttcctttgtatgtagcatcacttgttgattcagtccatttcataaaacaaactgttaaatcagtagaatttttaccattaaaaatactttcttggtctcctgtatcgatatctaattcaatatcttgatattgtcctttattttcttctgtacattttactgtaatttcattgttatttacaagatattgtgcattcttttttaagttgacaaacattgtttgtcctacttctgttaattgcacttttgcctttagtttatattttgtatttttctttaaattaactgtttgataaatattagcatttccattattttctggtaaaaaaccacaccagcttccttcatatgaacatcctggccattttgtaaatcttgcatttgtgacttgccatgatgtacggctatttatttcatagccagatgaaggatttgttccattttcaaaagaaccatttttaataagttctcgatctaattcaattaaatcttgtttaccattaggtaaaacagtaagtataactgttcttcttgttgatggttttgtagaatcagtactacttctagctgtatagtataagttatatttacccggttttaatttctttaaactttgtttatcatttttacctgaacaaactaaatcaacagaagtaagtccaccttttgatttaaatgaatattcattatcaattgaataatctaaaatactatcctgatcagaagtcacaccttctaataaattaggtgtttcaccttctgtcattgtcacatcatgttcaccattgattttgattgcattttcatagtattccttagaatctgctttttgttgagcattttgaccataataaacataatcaatttcatatttttgccctgcaagattatctccagcatctccagcccagtttccaccagttgctagattcatttgaatatattgtggtctgttaaaacatcttttatattcttcattattgctataatcaatagatcctacaattttattatcaacataaaattccattttatttttagaccaattaagaccaaaaatatgataatcatcattaaagatgccttttggtaatgtatatgttgaaatagattttgaatgatctacatctgcagctgaaccagcatgtaaagtttgataaactttcttattgctttttccatttaagtcttcattttctgcaccaatcatttccatgatatcgatttcaccgcaaactggccacgaagcaccttgttcactgctaattctaccatctaacgtaaaatctgaacctaatgtccaaaaagcagggaaagcaccttttcctttaggaagttttgctttcatttcaattcttccatataaaaattctcttttcccatgagttctaatacttcctgaattataaataacttgtctattgcctctaggatttttatattgatcttctttatctctattagttacttgtaaaactaattgtccatcttttacataaacattttctggatcatttacataatgttcttgttcaacacctcttattgaacctaattcataatcccaatttgaagtatctaattgacctttattaaaatcatcagcccaaaccatttcatattgatcatcttctgaagcattgcttacttctttaacggatacatcatcgatccatacttcttcttgaataatatcttggttaccattttcttctgtccatttaataaaagcaatagatccagaagtattatcacctgaattaaaagtatattctatatcttgatattgacctgctttatcttctgatgaagaaatcgtcgtttcaatcttttttccattattatcttttaatcctgcacttaattgaccattttttactgctaaaaatacttgacctttcgcattagaaatttttacttttcctttaacaacataatctgtatttttcttaaaacttactacttgataaactgctgcattattagaatttgatgataactttccataataatttccatcactttctccaaatgtacctgttcctgtttttttccatgaaccaccattattatcaaacccaccatttgtaattaaatcacttttacgttctaattcgattaaatcatgttcatgtgcaacacctgtttcttgacttggtgtttcagcaaagatcgttgctgaatacgaactaagcattgacattgatgtcaatattgataaaacaactttacttatttttttgtttttcataaaattttccctttctcttgttgttaccgcttccattagagtattatcgcataattttagtaaaagtcaatctattatttattatttataactatttttttactaaaataaattctaatgggctattttataaaattttatatcaaataagttcgattgttctttagtaaatacattatatttttattttcttttagtaaaaaagaactcccgtttggaagttcctctatattataattcttcaccattagaagcaataactttcttataccaatcataagaatcttttttgcttctttctaatgttccattaccttcattatctctatctacatagataaatccgtaacgttttttcatttcacctgttgtaaatgaaacacagtcaatacatccccaaggagtgtatcccattaaatcaacaccatcttcttcaacagcttttttcatttcttcgatatgagctcttaagtaatcaatacgatatggatcatggcatgaaccatcttcttctttaacatcaattgctccaaaaccattttctacaataaataatggtttttcatatctttcatagaacatatttaatgcatatcttaatccttctggatcaatagcccatccccaatctgattctttaatatatgggtttttaactgaatgttcacttgaaccatctgttgattttgaaacatcttttgtgactgttgaatctacaacatttgtcatataataactaaagccaatataatcaacagtaccttcagctaatgcttttttatcttcttcagtgatatcaatattgaatccttttctttcaaacatttttaaagcataagcaggataatgtccacggcattgtacatcgcagaagaagaaacgattatgcatttgttgttgtgctaatacttgatcagctggacgacaactaaatggataaattggaaccattgcaatcatatttccaattttgaaatcaggattgatttctttaccaatttttactgctttagcagatgctactaacgtatgatgtccacagatatacattgcttcttctggattatcatagtttccaaaatgagctccactgtttgtccaaccaaagatatcgtttttaaagttcatttggttattgatttcattgaaagtcatccaatatttaactttgtttttatatcttttgaaacatacttctgcaaatttaacaaagaaatcaattgttttacggttcataaatccaccgtattctttagctaaatgataaggcatttcaaaatgtgataatgtaataacaggttcaataccatattttaataattcatcaaaaacatcatcatagaattgtaatccttcttcattaggttcatcctcatcacctaatgggaaaattcttgtccatgcaattgatgttctaaaacatttaaatcccatatccgcaaacatagcgatatcttctttataatgtccataaaaatcaattcctacatgattaggataatatttaccttctactacaccatcagtgatttctctaggtacaccatgtgctcctgctgtcataacatccgctacagaatatcctttagaagtatttaatactcctccttcaaattgatgagcagctaacgctccaccccataaaaagtctttttgtaaagccatatactacctccgtcttcttttttatcattataccataaggttataaatctataaaatattctcttatcatttaaaccaacatttacaaaaatcagcttataaaagtaatcattgtaaataatatttacaaaaaaagccagagaatattctctaacttttagccctcgagaatatcccaaggttttctatcaatgattgtgagtatattttgatatcctataaattagaataccccattaaatcttcatcaactgcacgtgccacttcacgtccttctctaattgcccaaacaactaaagattgacctctacgcatatcaccagcaacatacaattgtttttgatttgtttggtaattttcatctgccacatttcctcttggtgtaagttttacatcaaaagctttagcaacataatcttcgcagcctacaaatcctgcagcaattaaaacaatatctgcatctaatgttttttcgcttcctttaacaggaaccatttgcatgcgaccttctacttgttttgattcaagtgagacaataacgacttgttttacatttcctttatcatctttaataaactctttaacagttgtttgataaagacgaggatcatgtccaaagacagcaatagattcattttgtccataatctgtctttttcacacgtggccattcaggccatggatttgaatccaaacgttcatgaggtggttctggcatcatttctaattgaataactgctttacatcctaaacgaatagctgaaccaacacaatcattaccagtatctccaccaccaataacaagtacatttttaccttttgtttcaacaaaagtttgatcttctaattgactattaagtaatgatttagtaattccagttaaataatcaacagcaaagtaaatacctttagcatctctccctggtgctttaatatctctagcttttttactaccacaagcaagaataacacgatcaaattctttatataattgttgaacttgttttttattttcaataccggcatttgttttaaaaacaacaccttcttcttccattaattcaatacgacgatcaataatatgtttttcaagtttcatgttaggaataccatacattaatagccctcctaaacgatcttctctttcaaagactgttacttgataacctcttttatttaattgatcggctgctgcaagtcctgaagggcctgacccaataattgctatttttttatcaatacgatgtttaggtggatggggttgcatccaattggaagcataagctgtttcaataattgcattttcattttctcttacggtaacgggatttccatttaatccacaagtacatgctgcttcacataaagcaggacatactcttgatgtgaattctggaaaattatttgtttttaaaagtctttttaaagcggctttataatttttatggaaaattaaatcattccattcaggtatcaagttgtttagtggacaacctgataccattccttgaatcatttttccattttgacagaaaggaactccacaatccatgcagcgagctccttggcatgattgttcatctctagataatggtttatgaaattcattaaagtttttaatacgttttaatggttcaacttctgttgatacttgtctttctatttctaaaaatcctgttggttttcccataatctacattcctttcttaaaagcattaaatgcttctacttttgcttgttcatttgtaagtccttgttgttcaaatgaactaataagtgacatcatacgtttataatcatgaggaacaacttttttgaagtgtgcaacttcatttccaaagtcatctaaaatctttttcgcaacatttgaatttgtatattgataatgtttttgaatcatttcttttaattgatcttcatcataacgtgatttcacatttttatattctacaagttctttattgacatgttcatagaatgtattatctggatcatagacataagcaatacctccagacataccagcagcaaagttacgccctgtttttcctaaaacaacaaccataccacctgtcatatattcaagaccatgatctccaataccttcaacaacggcatgtgctcctgagttacgtacggcaaatctttcaccagcaactccattgatataaacttcaccagatgttgctccatataaagcaacgttaccaatgataatattatcttctggtttaattgttgaatcttttggtggtaccacaattaatttaccacctgataagccttttccaaagtagtcattactatctccataaagatgtaatgttaaaccttgaggaatgaaagcaccaaatgattgaccacctgctccatagcagttaactttgaaagtatcttcttctaatgatgttccatatttcttcgtaatttctgatccaaagagtgttccaaatgaacgatcgatatttgtaacatggacatcaatttctttaccttgatgtttatctaaagcttctttaaattgtttataaagaactgttgtatctttgacttcatttaatttgaaatcatattcattatttttttcatgacgactatgtttattagatgtaaatggattatttaagatttttgataaatcaatattttcaacatcatccttgggttctaataaatcactacgaccaaccatttcatcaactgttttgaatccaagctgagccatatattctcttaattcttgagcaatgaaacgcataaagttttcaacatattcaggtttacctttaaaacgttttcttaaaataggattttgtgtagcaacccctactggacatgtatctaagttacatactctcatcataacgcagcccattgttacaagtggtgctgtcgcaaaaccaaattcttctgctccaagtaaagtagcaattgcgagatctctacctgtcatgagtttaccatctgtttcaataacaacacggcttcttaaatcattcatgatcaatgtttgatgagcttctgctaaacctaattcccatggaagacctgcattataaactgagtttttaggagcagcccctgtccctccatcatatcctgaaataaggataacaccagcacctgctttagcaacaccggcagcaactgttccaacaccagcttctgatacaagtttaactgaaatacgtgcttctttattagcattctttaagtcataaatcaattgtgctaggtcttcaattgaataaatatcatgatgtggtggtggtgaaattaagctaacccctggtgtagagtgtcttgttttggcaacccatggataaactttaccacctggtaagtgtccaccttctcctggttttgctccttgtgccattttaatttgaatttcattggcactacataagtattcacttgttactccaaaacgtcctgaggcaacttgtttaatagctgaacatttactatcaccattaggaagtgtttcaaatctttctggatcttctccaccttcaccactgtttgacttaccatgtaatctattcattgcaatcgccattgtttcatgtgcttcttttgaaattgatccataagacatcgcacctgttttaaatcttctaacaattgattccacaggttcaacttcttcaattggaattgattttgtctttttaaattgcattaaacctcttaagtttaaatgtgctccttcttcatcaatcatttttgaatattctttaaataattgataatcacctaaacgtgttgcttgttgtaatttatgaatcgttgctggattatataaatgttcttcttttcctgatctttctttatgatcgccggcactgtttaatgagatgtctacatctaatccaagtggatcatatacttgatcatgtctatattcgacatctttttcaatatctttaattgtttttccttcaatacgacttactgttttagaaaaatatttattcactaaatcacttgataaaccgattgcttcaaagttttgtgatccacgataagattgaattgtactaattcccattttagaagcaattttaacaataccatgtaaaataccactattataatcatcaacggctgcataataatctttatctaataaaccttgatcaattaaatcaaagattgtatcttgtgctaaataaccattgatagctgaaacaccatatccaagcaatgtcgcataatgatgtacttctcttggttcagctgattcaagaattaaagctaaactgttacgttttttagttcttactaaataagagttaacagctccaacagctaataacgaaggaattggtaaatggttatcatctactgccctatctgataaaataacaatattacatccttcatgataacgtttatctacttctacaaaaacacgatcaattgctttttctaatgaagtatttttaatatatgtaatattaacttcacctactttaaagccttcttttttcaagtttttgatttttaaaatatctgtattacttaaaatagggtgattgatttttaataaatgacagttttctggtttatcttccaacatatttccatctcgaccaatacaaatacttgttgaagtaatgatttcttcacgaatagcatcgattggtggattggttacttgtgcaaacaattgtttaaagtaattaaataatggtggatgttttgttgataaagctgcaattggtgtatcatttcccattgctacaatattttcattaccagttaaagctaaatttttaatatagtttgtatcttcataactataaccatgaatcttttgtaatttagttaattcttctccttcgtatctttctactctaatactaggaattctcatatcttttaaattaattaaattgctttccaaccattctccataaggttgttttgttgcatacgtttcctttaaaacatcatcttcaataagttcacctttaacagtatcaactaataacatttttccaggtcttagtctttcttttaaaataatatctttagctggaatatctaatgatcctacttctgaagataatactaaataatgatcttttgtaatgtaataacgtgatggtcttaaaccatttctatctaagatagcccccatgatgtctccatcactaaataagatagatgctggtccatcccaaggttccataagtgtagcattatattcatagaaatctttttttgcttgtgacatgcttttatcattttcataaggttctggaatacacatcatgacagctcttggaagttccatacctgacattactaaaaattccaatgtattatctaacatagctgaatcggaaccattgacatcaacaactggatatacttttgaagtatccacaacatctgtttgcatgttttcttctcgacagagcatgttattcgcatttcctttaattgtattgatttcaccattgtgaacaataaatctattaggatgggctcttttccatgatggcattgtatttgttgagaaacgtgaatgaactaaagcaatggcacttttataacttttatcttgtaaatctttaaagaataatcgaagttgttgtactaagaacattcctttataaacaattgtacgacttgaaagtgaacatacataagtatcttcaaattgactttgttcaaaaattcttctcacttgatataattttctatcaaaatctaaaccacaatttacgccatgaggttttttaataaatacttggacaatatatggcatggcatctaatgcttttttccctaaaacactaggtacagttggtacagcacgccaacctaaaaattctaatccttcttttttaacaactgtttcaaacatttttttgacacgtaaacgtactttttcatcttgaggcataaagaacattccaactccataatgtcctttttgaggtaatgtaaaatctttaataatcttttgaaaatattcatctggtatttgtgttaagattcctacaccatctccagtttcccctgctgcatcctttccagcacgatgttctaattgttcaacgatttttaaagcatcatctactgttttataagtttttaatcctttgatattaacaacggcccctattccgcagttatcatgttcaaatgactgatcatataaacctacattttctttgttcataaaggttcctcctttttttgtacagttagaatagcacatttagtaatatgtgtaaagattagcactttttttatgattttcctaaaaaatagctatattgtatacattttttaatgttttatcaatgatttgataatctttttttagcaaattaataaatttatttcaaaagtgagaaaaattttttttatttttttttaatttattggcattaaatgataaaaagagtagaataaatgtagtattaatatatggaaagaggagaaaaatatggaagatatgtttattgtcgaaacttctgctagacatattcacttaagtgataaagatttagcaactttatttggtgaaggtcatcaattaacaaataaaaaagatttatctcaacctggtcaattcgcttgtgttgaaagagtaaaagtaattggacctaaaggagaattaaatatgtctgttttaggacctacaagaaaagaaactcaagtagaaatttctttaactgacgctagaagcattggtgttcaagcattaattagagaatcaggagatatcaaaggaactgctggatgtaaattagttggtcctgcaggagaagttgaaattccttgtggcgtgattgctgcaaaaagacatattcacttaacacctgaagatgctgaaaaatttggagtaaaagataaagaaatcgttaaagttgaaattaatacagatggacgttctttgatctttggtgatgttgtttgtcgtgtaagcgcttcatatgcaacagctatgcatattgatactgatgaaagtaatgcagcagcttgtggtagagaagtttacggtaaaatcgttaaataagaaaaagaatggttttagatataatttctaaaatcattctttttttatacctataatatcttacttcgacaaattatgatataatcttcgtgggtgatgacatgaaaatattagatactcttggaaagtcaaaaaaggctattggtggtgttatagcaattatagttttagttattgcaatcttttttgcaggtgttcattatgcaagtggtagtaacaatgataaaattacttcaacaaccattaaaaatcaattaactgaaattaatgagcttgcactttattcatatgattatagtaaggtaggaaaattttctaataaattatcttttaatggttggaaaattcctttaacacaaaaaacttttattattacatatgatggatctattaaagcagggattgatttaaaacaggctaaaataagtatcgataatgagcaattaaatattactttacctgctgcaaaaattttaagtcatgaaattgatgaaaactctattgaagtatatgatgaatcatcaaatattttcaatcagataagtattaacgattataaatcttttgcgactaaagaaaagaaaaaaaatgaaaaagaagctatttctaatggtattttagaaaagtctaaaacaaaagctgaacaaaccttaaccacatatctacaggctattccagaaattaaagattattataaattaaatattacaattgaaaatacaaaaaccgatgagtaacaaactcatcggttttctattattatttattaacagctttttttaatgcagaacttgctttaaatgcaggtgctttacttgcagcaattgtcattgtttcaccagttcttgggtttctacctgttctttcactacgagtacgaacttcaaaattaccaaaaccttttaaagaaactttatctcctttagctaaagcatcagtaacaacttcaactaaagcagttactactttatctacatcagtttttgttaattcagtgcttgaagcaatagcttctactaattcagttttattcatttttattatctccatttctcgaaatttaggataataaatcctagtcatattctactacgttatctatttatttacaataaaatagtatgtatcaattataattcttctataaattgttcacatatttctttggacgttgcccatgatgtaactagacgtatacatgtatgttggtcatctattttaaacatatatgttgttatatagtttttatttattttttccaacgtttgttgatcaacgattggaaatatttgattagaaggactttcaatatacatcttatagcctttatctttgaatccttttcttaatatatcagcacattcattttcatgttttcctatttctagatataaatcattttcaaataaagcattaaattgaactcctaataatcttcctttagcaagcatggcacctttttgtttaatatgatatctaaaatcggtttttaattcatcattaataataactaaacattcaccaaataaggctcccatttttgtaccaccaatatagaaaacatcactataaagcgccatctcttgtaaagttggtgcatctttcaagacaagtgcacttccaagtcttgctccatctataaataaatataaattatttttttgacagcattcataaatggcttttaattcttctaaagtatagtacgtaccatattctgttgtttgtgaaatatataccattttaggttgcaccatatgttcatcaggatgttcacgcatgatttcatcaatcatttcaggaatcatctttccatcttgatgtggctttgttaaaatcttatgcccggtaaattcaacagctcctgtttcatgaacattgatatgtccactatcaacagcaataacagcttgataatcttttaatgctgaagaaatcataatcatattggtctgtgtaccacctactaaaaaatgaatatctacattttcattttctaatattgcttttattttatctttagctttttgacaatattgatcttccccatatcctactgtttgaataaaatttgtcttatttaaagcttccatcacttgtggatgagctccttctaaataatcacttgcaaagttatacatcttaaccccctaaagaaaataggaaacattgtttcctataattcttctccatttgtttcaattacttttttataccaataatatgaatcttttttgtatctatttaaagtacctgaattttcatcttcttcacgatcaatataaacaaaaccataacgtttttgatatccgtttagccagcttaataaatcagtataagaccatgtacaataagcaagaacacgacaaccatcatcacatgcttttttaagttcttcgatatgacgttttaaataatcaatacgatatggatcatgaatttgtccatcttctaatttatcaaatgcacctaaaccattttcggaaataacgattggtaaatcataacgcgaagtaatttcacgacaacacattctaattcccattggatcaattgtccaatcccaatctgttgttggtaaaaactcattttgtggttttttataaagacccggtacaccttgaactttagcggtacctttttttccagtgttattcattgtatgatcactaccaacaccattaatatcattatattcaacaacacatgtttgataatagttcacacccatgaaatcaataagtgaagctgcttttttcattaatgcttcatcaccttcttcgaagacaggagcacaccctaatgattttaaatattgaatagcagcacgtggataacgtccataagcataagcatccatccaataataattttgtaaatcatcatagtccgctttagccattgcattttcaggtttacgatcataagcataacttggactataagcaaatgaagcccctacttttgcttctggatgaagttcttttaaagctataacacttttagcatgtgcaatattggcatgatgattgacttgatagaatgttttcatatcatctacttttcctggtggatgcattccttctaaccatccatgtcctgtaaagatattttgttcattcattgtaatccaatattttacacgatctccatatcttttaaataatgttgtggcataatttacataatcatcaacaatttttctgctttcccaaccatgatattggtcttctaaagcttgtggcatatcccagtgataaactgtaaccataggttcaattccatattttaataattcattgataagattatcataaaattctaaacctttttcattgacttcaccatttccatttggataaatacgtgtccaagcaattgaaaaacgatatgttttcaatcccatttctgccatcaacttgacatcttctttgtaacgatgataatgatcaacggccttatcacctgttgttgctttaaaagtctttcctggaattcttacaaatttgtcccagttggaaacacctttaccatctgcatcccagccaccttctacttgataagcagcagatgcacttccccaaagaaaatctttaggaaatccttttgtttctttaaaatacattctttttctccttatttcatatattttttgataaactgacttaatgtttgtttaaagtcatcgttttcaacaagttcatataagtatttttcatcttttaagacaaacaatactttttctcctctatttttattatatagcggataaaccatctttaatggtacaaaatcgtcatcttttgcatgaaaatacaatgtaggtatatcattgtgtctaacatattttgttgtattttcttttaaatcaatatgcacagctttttttatatgacgtgcaataattgaaattgctggatattttgaaatcttataatctgcttctaaacgatatccaataatatcatatggtgacgtataagccccatctgaaataatagcttcaacattttttaaaacatgtctacctgaagcatttaaaattgtatttgctccttgttctttaccatacattaatattttatgatctttcccataagtttctaataggtacttattccaacatactaaatcattgacatccttgattccaaatcctctaatataaccatcactttgtccatgtgcacaagcatctattaataagatttgtgcttctggcaaatggtcttcaaaatatggaacatataattgcatatcttttgcctgtaaaccaaatggatgtgaaattaaaactgtcatttgagggttttctttaggaatcaaaattcctcttaattgaatatcttgatcattttttatataaatattttgactattgaattttgtttctaaaatacttggtctatcttcttgtttatgatgtctgtataataatttttttgcatattttttggataatgtgaaaacagatgctgctgcagtagaaacacctcctaaaactaataatcctttaattgctgttttattattctttaccatttgaatattcctccttatattcttccattaataatctattaatattagctacctgttcaaatgaagtaagacgatattcatcatgattcatccttgctgcatagaaacgaattgctttttctaattccaaacgcataatttctttatattctggtggaaatgttgaaattggaaaacatacaaataagaatgtattataatcttttgaaaataaatcgataagtaaatcatatccttctatttctaaaattctatttcctatttctttttgtaaatcatgattagcaaaagtcaacacatcattcattacaaaacgtagaatatcttcacatgcatcgatatattgttcatgattattttgataaagtgatttgagatatgaaataacaatattattttctaactgatctggatttaatctttcaaaatgattaaataatctttcagcaacttctttattcaataaaataaagcttccaaattcttttataattgaaagtgtaaatcttggcatttgacataaacgctcaaagatttctaataattcatctttagttgatttaaaaaagccatctatatgatttgtcattttctttatggtctctttaaaatattctaaatgaaattgatattcagtatctaaatattttgcatttactccatcccattcatattcatataaaattttatctaataaaagagctattgaatccataaattttttataatttttattatataataatctatctaaatatggattaaaaaatgtataaaattcatcaacagtttcttggtttgtaccagaatgatattctaagtaatctagaatatttcgataatctaaaggttctaatattgtatcaactgtatgtgtttcaataaaatgctcaaaaacatgacaatgtaaaattgttttaaattgattaaaataaagaatcttatttaaagcatcttttataatgtattcttgttcttgttcatgaagattaacagaaaatgttggtacgatctcatctccagaataatctatagtaacaaatacatcgattgctttaaattgaatatctaaaatataataatgaaatttatgttcaaatttttttgtttgtactgcactatgacacctgtatcttcctatatatgtgcttttatgggtttctaaatatttttcaatacattttcttgccatcattttttctcctttatattcttattttaccatttttgattattgatgaaaacaaaaaaaggaaatcaatcaatgagtttcctttagttatcatctttataaaagtttctaattatatcggattataagaactataatctatttcctgggaaatatagcaaatattgttttatttataaaaaacttcatgcaaatatagtccttgtggtttagctttaaataaacactttttttgtcctttactttctattaactcttctaaaaattctttagtaattctgtgtgcccctacttgaatcaagccaccaactaaatgtcttaccatatatcttctaaatccattacctacaagcttaaaagtaacaatacctcgattattttcaatttcaatttgataaagtgttctaattgtattgccatattgatcaacagcacaaaaggatgcaaagtcgtgttcaccaataaaaatttttgcagctttcctcattgcttctatatctaattcttttccatattgataaatataatttgtttcgaatggagaataatcattcatacttaacatataatgatattctttcttagtagcagaataacgactatgaaaattttcatcaactaagaaactatcaataatataaatatcattaggtaaaaagtgattaatagcccttttccattgtttttcaggcatttcccttaaagtatcaaagtgaaagacttgtcttctaccatgaactttagcgtctgttcgaccacttgcatgaataacaatactttcatctttacagatattttttatagctttttgaatttcaccttgaactgttctaaattgattttgaacttgaaatccgtgaaatttactaccatcataacttacaatacattttattctattcattacataaaactcattataatcacaccacaacatacacctaatgttattaacattgataacgtatctaaatgtgtccatgttaaaactttgtattttgtacgtgttgcttctggattataatttctactttccatagcgttagcaagttcttctgccctttgaaaggcagaaataaataaaggaataattaatgaaataattgattttattttttccatgaaagatccctcattaaaatccgcacctctactagcctgtgctttcataattcttttcgcttcatctaataaatcaggtataaatcttaatgcaattgaaatcatcatagcaagttcatgcactggaaaacgaaatctttttaatggatttaataaactttcaatagctagtgttaattctaaaggcttcgttgtagaagtcattaatgttgttaaagtaataatcaatacaagccttataaaaatataagcagtttgtaataaagcacctgagtagatactaatacttcctatttttattataacatcacctgttttcattaaaaatatattaaaaatcatcaaaaacaacatcataaagaccatcggttttattgcttttaaaatatgagaaagtttaattttagaaactaacgaacataataaaacataaattgctaagataccgtatcctataaatcccgcatcaaaaaaaacagaaattaaaaatatgaaaacagcacatatttttaatcgtggatctaaacgatgaattattgaattccccggtatatatttaccaaaagtcatattatccatgaagttcaccaccaatcacttcaactaaagcatcaatatcattgatagatgtatctatatgatagccttttagatttaactgaataataagatttgtgattaaaggtaaatctattcctaaatttaataaataatcactatctagaaaaatatcttttactttcccagctttttcaacttgtccgtcattcattacaacaacattgtcgcaatattctaaaacatggttcatatcatgagttactaaaactactgttttacccatttcatgaatttttttaaataaatccatcatttctttaatccctgatggatctaatccagctgttggttcatctaaaacaagaatatctggatccatagcaagtattccagcaatcgctaccctacgtttttgaccacctgataaatcaaatggggacttttctaaataagtttgatctaaacctaccatttcaagagattttttagctatttctttagcacgattttcgtcaattccaaaattcattggaccaaacataatatctctttcgattgtttcttcaaacaattgatattctggaaattgaaaaacaagacctgatttttttctaagactttttaaattttgaggcttattattttgtgaaataatataatcatctatttttatttctccacttgttggtaataataaagcatttatatgttggataagtgtcgattttccactacctgtttgtccaatgatagctgtaaatgaacccttttctatttttaaattcacatttttaagtgcataatattcaaaaggcatattatatccatatatatgatctaaacttttgcatgtaattgacatagttgtttctccaattcttctacatctaatgtatctttaatttgataaccttttttttgtaattttctagcaatttttaatgaaaaaggaatatctaattttaattcttttaataatttttcatttgttaatattttttgaggtttgtcgcaatctacaatctctcctttatttaaaagaataactcggtcagcattttttgcttcttcaatatcatgcgttattgaaatgattgtcatattattttgtttctttaactctcttactaattcatttatttcttttctacctcgtgggtccaacatacttgttgcttcatctaaaataatgatagatggactcatcgctaaaatacctgcaatcgcaactctttgtttttgaccacctgacaatttagttggttcatgatccaaaaaattctccattctaactactttagaatacctattaataagttcatccatttgttctcttggtacacaaatgttttccagtccaaaagctatatcatctctaacagtagcaccaataaattgattatctggattttgaaaaataattccaactttttctcttattttatataaattttctaaatttaattgataatcatcgatataaatttcaccagattttttttctaataatcctataagtaatttagcaattgtacttttaccactaccattatgtcctaaaatagctacatattcacctttatggatttgaaaagaaatattgcttattgtttgtaatccaggttcgtattcaaaacataaattttctaccttaattatttcttccattgtcttctcctcatgaatgtgtttagttcattctataatttataaagaaacaagtcaaataaaaaaggactgaatttcttcagtccaacatcattatttagttaatgataagattgccattggtgcattatcacctttacggttatatgtttttaagatagtagtatatccaccattaacatctttgaatttaggtgcaacgtcatcaaacaagatttgaacagctgtttttccagttgcttcatcaacaactttgtgcatatctgcagcagcttgtcttcttgcatgtaagtctccacgtttacctaaagtaattaattcatcaacaacactacgaacttctttagctcttgttacagttgtttcaacttttccgtataaaataacttcagtagctaaactacgtaacatagattttctaatatctgaagtgcgtcctaattttctatttttagccatgagattaacgctccttttcgagtattctgaattaatcgataggtttaaatcctaaacctaattcaattaatttttctttaacttcttttaatgattttttacctaagtttcttactttaatcatgtcatcttctgatttagaagcaagatcttgaactgtttgaataccagctctctttaaacagttatatgaacgaacagataaatctaattcttcgatagtcatatctaatactttatttgtagtatcactttgagtttcagacataacttccatattcatagctatatcagttaattcaacaaacatatttaaatgttcaactaaaatttttgctgctaatgaaatagcttcaaatggttttagtgaaccattagtttcaacttctaatactaattgatcatacttagcactttctccaacacgagttggttctacagagtaagcaactttttcaattggtgaaaagattgaatctgttggaataacaccaagagtgttaatatttactttattttgatcagcagatacatatccacgatcttttttagcaaataattccatatataagtgaccaccttctgcaacatgtgcaattaccatgtcatttgaaatcattttgacttcagctggacattgaatatcagcaccagttacagtagcaggaccttttacatcaataatcattgtagcagtgtcttcactgtctacatcaaaaactaatttcttaatatttaaaatcattgctgtgacatcttcaacgacaccatcaattgcggaaaattcatggattgctccttgaactttgattgcataaacagcagaaccaggtaaagaagaaagtaaaactcttcttaaggcattacctaaagtaataccgaatcctctttctaatggttcaatgacgaacttaccataattttcagtttcgtcataatgatctatattaaagtttgctttttcgaatttatgcatatgttccctcctctataggaatgttttgtattctaatttactacaataatactatccacgaggacgttttggtggacgacaaccgttatgtggaattggtgttacatcattaattgaagtaacttctaatccagcagcttgtaaagctctaactgctgcttcacgtcctggtcctggaccttttacatttacatctacagtttttactccgtgttccatagaagctttagctgcagcttctgatgccatttgtgcagcaaatggtgttgattttcttgatcctttgaaacctaatgctccagcacttgaccaagttaatacgttaccatgttcatcagtaattgttacaatagtattattgaaagtagaatgaacgtgtgcaacaccttttgcaatattttttcttacacgttttttaccacgtgtttgttttactctagccatttcctttcaacctcctattattttttctttcctgcgattggtctagctttacccttacgagttctagcattagttttagttttttgaccacgaacaggaagtcctttacggtgacgcatacctctgtaacttccgatttccattaaacgtttgatgtttaattgaacttctctacgtaagtcaccttcaactttaattttttcaacttcttttctgatttttgtaacttcttcttcagttaaatctttaactcttacatcttcactgataccagtagcttttaagatttctttagctgtagatttaccgataccatatacataagttaatgagataacaacacgtttatcacgtgggatatctacacctgcaatacgagccattttgtttcctcctaaatactaaccttgtctttgtttatgttttgggttttcgcaaataatcattacgcgcccttttcttttaattactctgcatttatcacacattggttttacagatggtcttaccttcatcctgtctacctccttttggaagattttttatttatgtctaaatgtaattcgcccacgtgttaaatcatatggagatatttcaacggtaactctatcccccggtaaaatgcgaatgtagtgcatacggattttaccagaaacgtgagcaagaatttccactccattttctaaagctactttaaacattgcatttggtaacgtttctaaaacagtagcttctacttcaataacgtcatctttttttgccatcgttcttcaactccttttattaaagttttgtaagaattctataaccgtcatcagtaatgacgattgtatgttcataatgagcagctaacgaatgatcctttgtaataacagtccacccatcatcaagagtaactgtttcttttgctcctaaatgtgccattggttcaatagccaaacacatacctttttttaatctaggacctctcccaggagctccgtaattaggaacagcgggatcttcgtgaacgtttgttccaatcccatgaccagtataatcacgaggagtagtacacccgtttttagtaagatattcttcaattgcatgtgaaatatcagaaagtctaactcctggttttacttgttctaatccagcaaataaagcactttcacaaacattcataagtctttttgtttcattgcttacatttcctactgcataagtccaagcactgtcaccatgatatcctttgtaacatgctccaacatcaactgaaataatatctccatcttttagctttctattactaggtattccatgtactacaacttcattaattgaagtacatacactatttggaaaaccataaagatgtagaaaggaaggtgttgcaccatgttccctaattattttatcacaaatttgatcaatttcgttagtagttattcccggtacaataacttctttcaatttttcatgaactaaagcaacaattctacctgcttcagtcattaattcaatttctctatcatctttagtaattatcattaataaacctccaggctttcatcgatatcataaagacgttaaacataacttcttaactttgataactgcttcttcaaaattaatttatttctttagatatttatgaatccataaaagaaatcattattatttacgaatataaccatgatattcttttctagtaatatatgttttgatttgttttactgtttcaattgcaactcctgtaacgataatcaaaccagtaccaccaagtgataggcttgcattttcagtttgtgtccaaataattggagtaataattggaattgcagcaataatacataaagtaagtgaaccagcaacagttacttgattaagaactcttttaatgtagttcttagtttcaataccagttcttacaccaggtattgatccaccatttttcttcaaatcatcactaattttttcagcatcaatttgtaagtttgaataaaagaaagtaaatcctataatcattaaaatatataaacagaaaccaacaggttcttgataattaaatatagtatttatcatcttagttgtactagatgctttcatgaaacttactattgttcttggtgctgctagtactgaagaagcaaagattactggtaaaacacctgaactattaattttaataggcatatgtgtttgttccctagctctcattgttacacttgtactagatgcataattgactgggatttttcttattgcgccttcagtaaatactacaaagactacaattgaaagataaaccacaacaaataatacataccaagcaatatctaaccacattccactatcataagtgacgaggttattataagttgttaagaatgcatttggtaagtttgaaacaattcctgtaaagattagtaatgaaacaccattaccaattcctttttgagtaatttgatcacctaaccaaatagctaacatacttccagccatcataatgagcactacataaatatatgaccagattgaagtatcaactaatatattataacttgtatcaaaggcataagttaaaactccaccttgtaacgcagctaataataaagttaatacacgagtaacacggtcttttttcttcttacctgtgttaccttctttacgccagcgtgttaacgctggaataacatccatcgataataattcaattataatagatgatgtaatgtatggtgaaacacctaaagcgaaaagagaaaatctttccaaggtacctccaccaagtaaattcatgattccgaaaattccatttgtagcatcactactacttaatgaacctacattaacacctggaattgtaattcctgcacctaaacggtacacgaataaaattccaagtgtgaaaatgacttttcgacgaagttcaccctttttgaatacattcttcaaaaaagttaacatcttaaatcacctcagtttttccacctgcagcttcaattgcggcaacagctgatttagagaatttagcagcttgaacagttaatttcttttcaatagcaccatttcctaatactttaacaccatctaattcttttttgatgattcctgcttcttttaacgcagcagcattaactgttgcaccatcttcaaatttatttaaagtttcaagatttacgatagcatattctttacgagtatagtttgtaaatcctcttttaggtaaacgcatgaataatggagtttgtccaccttcgaatcctggttttttacctccaccagatctagctccttgacctttttgacctctacctgctgttttaccatttcctgaactcgtaccacgtccaacacgttttcttgctttacgagcaccttcagtatattgtaattcgtgaagtttcattgttacacctcctattatttttcttcaactgttactaggtgtccaactactctaatcataccttgagtagtagggttattttctaattcaacagttttattaattttagttaaacctaaagctttaagagtctttctttgatttggtaagcaaccaattggactctttttaagtgtaatacttacttttgccattttgtttgcctcctatccaaaaatttcatcaacagttttttctcttaattcagcaacttcattaactgtttttaatgaagctaatccttgcattgttgctcttaccatgttgattggtgttctagaaccaatacatttagataagatatcacggtaaccagctaattcgacaacagcacgaactggtccaccagcgatgattccagtaccttgagatgctggtttaataaatacatttcctgatccgtaaacaccgtttacttcatgaggaatagtaccatgtacagaaggtactttgataacattacgtttagcattttcacatgcttttctgattgcatcaggtacttcgttagctttaccagtaccaaatccaactctaccttttctatctccaataacaactaaagcagcaaaacgcattctacgtccaccttttactacttttgttacacggttaatagtaacaacacgttcttcaaattctttttcttctcttcttggtgctcttctttgaccatttcttcttggttttctttcaccattgttagttcttggtttacgttgttccatattgacctccttctagaattctaatccagcttctctagcagcttctgctaatgcttttacacgaccatgataaatatatccaccacgatcaaatactacatttttaatttcttttgcaattgctctttctgcaatttctttacctactgcagttgcagcagcaatgtttccaccgttttctaatttcatttcaacgcttgatgcgctaactaatgtaacaccattgacatcatcaataatttgagcgtgaatatgagcatttgaacggaaaacatttaaacgtggacattctggagttccactaatttttctacgaactctagcatgacgttttaaacgtacatcattacgagattgtaatttagccataaagatagctcctttcttactcttagactacttcttaccagcagtttttccttcttttctgatgattctttcatcactatatttgataccttttcctttataaggttcaggttttttcttagatctaattaatgcagccatttgaccaacacgttctttatcaattccagaaactacgatagtatttggggttggagtttcaactttaactccttcttcagcttcgatttcaacttgatgtgagaaaccgatatttaatactaatgtatttcctttcatttgaccacggtatccaataccaacgatttctaatgttttagaatatccattatgaacaccttcgatcatgttagcaagtaaagctcttgttgtaccatgtaattgttttacatgtttttcttcactacttcttactacagtaatttcattaccttcttgtttgaatgaaattactggagaaaattgtttcactaaagtcccttttgatccagtaactgttactgtgttatcatcagcgatttcaacagttactccttcaggtacagtgataattttattaccgatacgagacatcagttatacctcctgtataatttttttattaccagatatatgctaatacttctccaccaacttgtttagctctagcttctttatcagtcattaaaccttgtgaagttgatagaataacaatacctaaaccatttaatactctaggaatttcgtttacttttgcatatacacgtaaccctggtttagaaattctttttaaatcagtgattactttatcttttcctctatattttaaagtgataataatgtttgattcagcaccttcgccttcaactttataccctttaatgaacccttcattttttaagatttcagcgattccaacttttaatgttgaagtaggaatacttacttcttcttttaacgtattatttgcgttacggattcttgttaacatatctgcaattggatctgtcattaccatttgcgtgtcctccttccaatacggattattttatcattaccaacttgctttttttacaccaggaatttcacctttataagctaattcgcggaagcaaattctgcaaagtttgaactttctaattactgaatgtggtctaccacaacgttcacaacgtgtgtattcacgtactttatatttttgaggacgttgttgtttcactttcattgatgttttagccatttattaagtcctccttatttatggaaaggcattcctaattgagctaataactcatgaccttcttcatcagttttagctgttgttacgaatacgatatccattcctcttaatttgtttactttatcaaaatcaatttcagggaagattaattgttctttaacacctaaagtataatttcctcttccatcgaatgagttatttgatacacctctaaagtctcttacacgaggtaaagatacatttactaatttatctaaaaattcatacattctttcaccacgtaaagtgactttacaaccgattgcttgaccttctcttaatttgaaaccagcaattgattttttagctctagtgacaactggtttttgaccagtaattaatgttaattcattaactgcatcatctaataattttgaattagatactgcatcaccaacaccaatatttaatacgattttttcgatttttggtgcttgcattttagaagaataattgaatttttccattaacgatttaactacttcgttttcataacgttcttgtaaacgattcatttgctatctcctttcaattatttctttttcttagaatcaacttctgcacctgtttttttgttaacacgtactttagttttctttccattttcatctacagctactttatatcctaatttaactgcagattttgattttgaatcatagaatgcaacattagaaacatgaattggagcttctttgttaacgattccaccttcaggatcagcttgtgaaggtttaacatgttttgttaccatgtttactccttcaacgattactctttcttctttagcaagaacttgtaacacttcacctgtcttacctttatctttacctgcgataactacaacagtatcaccaacacggattttcatgtgccacgcctccttataatacttctggagctaatgatacgattttcatgaaatcagcatctcttaactctcttgcaactggtccaaagatacgagtccctcttggagacttgtcatctttgataataacacaagcgttatcatcaaatttgatgtaagatccgttttcacgtcctacagcatatttagttctaacgataacagcttttactacttcaccttttttaacagtaccatttggagctgcttgtttaactgttgctacaacaacatctccaatactacttgtttttctatttgacccacctaagttacgaattactaatacttctttagcaccagtattatcagcaactttaagtctactttcgttttgaatcattccggttacctccttttagagtttattaaactgtttctgctttttttacgatttctactaaacggaaacgttttgtagcagataatggtcttgttgacatgattttaactgtatctccaacttgagcagtgttattttcatcatgtgcatgaaattttgtagatgatttcatacgtttaccatataacttatgttttacatgtgtttcaactagcactgtaatagttttatccattttagtagatacaactgtaccagtataaactttacgattatttctttccatttgtatctcctcctattggtttaattctctttctctaatcactgttttaatacgagcgattgttttacgaacttgtctaatacgtgcagtgttttctaattgtcctgtagcttgttggaatcttaatccaaaaagctcttttttgtattcttcaactttagctaataaagcttcagtatctaattctctaatttcttgcgctgtcataactattcaccctttccaatgattttacatttaataggtaatttatgagatgcaagtcttaaagcttctcttaatgtagcttcatctaaaccagcaacttcaaataatactctaccagttttaactactgctacccattcttctggagaacctttacctgatcccatacgtacttctaatggttttttagttttagctaaatgagggaaaattctaatccatactttaccaccacggttcatataacggttgatggcaatacgtgctgcttcaatttgacgagaagtaatccaagcaccttcagttgctactaaaccaaattcaccaaatgatactttgtctccacctttagttctaccttcgtagctaacacggtgaggtcttctgtattttgttcttttaggcatcaacatgattatttatcccctttctttttttcaggaaggatttctcccttacaaatccaaactttaactcctaatttaccataagttgtatctgcttctgcagtcgcataatcgatatcagctcttaaagtatgaagagggacattcccttcagagtaaccttcagcacgagccatatcagctccacctaaacgtcctgaaacattagttttaattcctttagctccagctctcattgctctttgaatagcacgtttttgaacagttctaaaagatgcacgattttctaattgttctgcaatattgtttgctactaattgagcaacaacatctggatttttaatttcaacaatgttaatgaaaacttgtttactacttactaatttagatacttcttttcttaaagcatcaactgcttcaccatctttaccgataactacaccaggtctagatgtgtgaacaaaaattgttacacgattttttgatctttcgatttcaacttttgctactgaagctgttttaagttttttaagaatataatcacgaactttaatatcttcatgtaataaaccagcgaaatcttgatcatttgcgtaccatcttgaatcccaattacggttaacaccaacacgtaaacctactggacttactttttgacccattctagtacctcctatctttcatcaaccacacaagtaatgtggcatgttctttttaaaattcttgttccgctacctttagctcttgcagcgaatctttttaaaattggaccttcatcaacgaagattgctttaacatataatttttctgcatctgcatcattgttgtatactgcattttgagctgcagatttaacaacttttgagattgcaggagaagcagctttattagtatattctaagataccaagtgcttctttaactgttttacctcttactaaatcaactactaatcttgctttttgaggtgatacacgaattgttttagctactgcttttgcttccatgttctattctcctctctatttctttccttttttatcgtcagcatcatgaccatggaaagttctagttggagcgaattctcctaatttatgaccaaccatgtcttcagtaacgtaaacaggaatatgttcttttccgttatatactgcaaatgtatgttcgataaattgagggaagattgttgaacgtcttgaccaagttttgataacttcttttttacctgattcatttaacgcttctacttttttcattaaatgagcatcaacaaatggtcccttttttaaactacgtgccattttttctttcctccttattatttaccattgcgacgacgtacgattaatttagtcgaagcttttttgttctttctagttttaacacccatagcttttttaccccaaggagtcattggtgctttacgtccgatagaagttctaccttccccaccaccatgagggtgatcattagggttcattacagaaccacgaactgtaggtctaacacctttccatctcatacgtcctgctttaccatagtttactaaaccatgatcttcatttcctactacaccaactgtagctctacatactgataataattttctaacttcaccagatgcaagtcttacagttacatattttccttctttacctaaaatttgagcagacacaccagcagatcttgcgatttgtccaccttttccaggttgcatttcaatattgtgaattacagtaccttcaggcatattccccattggtaatgcattaccaactttgatatctgcttcttcaccagaaatgatttccattcctacttctaacccttttggagctaaaatatatcttttttcaccatctacatagttaattaatgcgatgtttgctgatctatttggatcatattcaatagttgcaactttacctgggatattatctttatttcttttgaaatcgataatacggtatttttgtttgtgtccaccaccatgatgacgagttgtgatcacaccttggttgttacgtccaccgtttttagatttttttgcaactaaagatttttcaggtttattagttgtaatttcttcataagttaatgaagtcatattacgacgaccgtttgtcactggcttatatgttttaattgccatctttagtttcctcctgtttttcttatctggaacgagttattccaatattttatcaattaatcttcatcaaaataattgattgaatttccttcagctaatttaacgatagcttttcttcttttgttagttttaccttcatatctacccattcttttagctttaggtttaacattcatgatgttaactttttcaacttttacattgaataatttttcaactgcgattttaacttctgttttgttagcgtctaaatctacatcgaatgtatatttattttcttcagtttgaagagctaatgacttttcagtaagtactggtttttttaatacatctgtcatgtgtgccattatgctaatacctcctcaacagctttaattgcagcttcagtcataattaacttatcgctgtttaagatatcataaacattaacatgtttagcatctaataacttaactcctggaatattgcttgctgatttttcaacatttaatgtgatttcatcaacaacgattaatgtttttactggagaatttaagttttctaatactttaaccatttgtttagtttttggagcttcgaatgaaattccatcgattgctgtaaattcattatcttgaacttttgaagataatgctgattttaaagctaatcttctaactttacggtttaatttgaatttataacttcttggtgtaggaccgaagacaactcctccacctctccattgtggagcacgtgttgaaccttgtctagctctacctgtacctttttgacgccatggttttcttccaccaccagcaacttcagtacggtttttaactttatgtgtaccttgtcttaaagatgctctttgtaataagaccatatcaaacatagcttgtttatgtggttcaataccgaaaactgcttcatttaattctaagtctttaacttctgcaccttcttggttaaatacttttacgttaagcattctcatttcctccttcttcaaattattctgcagcagctgcttctacagcttcttctactacagtttcttcaacttcttctggagtgtaatctactaattcatgtactggatttacttgaccagcttttttgatagcagttttaacaacaactaaaccttttttaggtcctggtactgaacctttgattaataataagttgttttctggatctactgctacaacttctaagttttgaattgtacgagttacatgtcccatttgtcctggtaattttttacctggagcgattctatttggagcgattggtcccattgaaccaacaattctatgagctcctgaaccatgtcctttaggaccaatgtgttgtccatgtctcttaataacaccttgataacctttaccttttgaagttcctgttacatctacgacttcaccagctacgaagctatcaacagtaattttatctccaacttcataactcatcatttcgtcataacgaaattctttaatgaagcgcttaggagctgtgttagctttgtttgcaattcctttttcagctttgtttgctaatttttctcttttatcttcgaaaccaacttttacagcatcataaccatcagttgcaactgttttcttttgtaatactacgttttcagtagcttcaacaacagtaactgggattaaaacaccatcagtagtgaagacttgagtcattccaatcttacgacctaagattcctttcatgagttacaccttttacctttcttataatttaatttcaatatctacaccgctaggtaattctaatctagttaaaacatcaactgtttctggcgtaggattcacaatgtcgattaaacgtttgtgagttctgatttcaaattgttcacgtgaatctttatatttgtgaacagctctaaggattgtatatacttccttttcagtaggtaatggtactggaccaactacttgagcacctgatttttttgcagaagaaataattttttctgctgacgcatctagaattttatgatcaaatgattttaatctaattctgattttattatttgccatgatattctctcctttcaaattcatataggatttgattcactcgttacgaattacctgaaacatgccgtttcatgacaacgcttttcggtgtttcagcaacctcgcacttctacgtgacatcaacatgggtattatatgataattatgtccataatgcaatacttttttttatttttttataaaaaaatttacaaagaaataattttggataaataaccatcttattaatagaatagatactaattttgaacttttagctttgattatttaataaaaataatcattcttaaatggatagttattaaagcaagttatctttaaattaaataatcaataaaaaatatatcaatacttacatttgatcactataaaaaatagaatatttaatatcaatgatcaaatacatactaaaaaatccataccacaagggcatgacctgtcaatgatcatgtaaaaacataaaaaaaaggatcaatttgccatccccaatcagaacttggaatataagggtttttaatcgcaatattagtattagcagctgttttctttaatccagcatcatctttagcaacacagcttgatgaataataactaaatgaaacaaaatcaactggatattttttcatgatttctaaatcatgttcttccattttaatatttaaaccttcatttttaaatttagttaataaataagcaggatattctccaaagacttgagtatcgctataacaatacgtacttctcatatcttgttgtgcttgtaaaacatcttctggtttacaagtatatggataataagttaattttgtaagcatacatcctactttacagtctggatttttttcatgcgcaatttttgttgcaagagcacttgcgacaaattgatgatgcattgcttggaaaataacttctgtaaagtttttaccttcaaaacgatctcttacaagtcctcctgttgtataaggatgtctaatcattgaatcaacttcattaaaagttaaccaatatttgactttatctttataacgatcagtaataacatctacatatttaacaaacatatcaataacttctcgatcataccaaccattataatttaatactaagttgattggtggttcatagtgtgacattgtaacaagtggttcgataccatatttgtgacattcatcaaaaatatcatcatagaattttaaaccttcttcatttggttctttgtcatctccatttgggaaaatacgtgaccaagcaatagaaagtctaaatactttaaatcccatttcagcaaataatttaatatcttctttataatgatgatacccatctgaaccatgtctttttggataaagacttgtatcatcacttttcattgcttctaaaatttcttctgttgaaatttcattttgtttagcataatcttgaacatctacatctaaatgatggcgagcacaatcggaaacagaaactccttttcctccttcattccatccaccttcatattggttagcagcaacagcgccaccccataaaaatccttctggaaatttttttaccattttaatatcctccgcttttctctaaaaccatcttaacaccttatataaaaaaagcatgattatttcatttaatgaaaataatcacacttttaattaatcatgtatttttttagccaaacacatttccacaaattcaacatcaaaatgtttagcccttgatcccgaatatcccatatctaatgatgaaatttgtttcatttcttcttcatttaattcaaaatcaaaaacatctatattttctttaattctttctacatgtgttgattttggtataacaatgactgttgaatgaatatcaaagttgatattattattagattctatgattgagttaagatagctatcaatataagaaatattgcagaagcgattcatttttgatgtaacgtttgtatttattaatttattaatatattgtaaagaagcttctgtattttgatatgcgataagttgcttaagattaagtaaatggtttttataatcatgttttaattttcttaaatcttcattttctatttcaagcccttgataataagctttatcaagttgttgagctttatacatagatatattgatatcttcttttcttttaagaatgtaacagtaattaagagaaactactataattattgataaaagaagaaatcctaaaatgagtaaacccaaataataatttaagttattaataaagaaattataggataaaatgaacatgaatataaaaagtatgatattaatcagtattataagaacaagatcataaatattaaattgcacagaattatttaagaatgataattcgtttaaataatagaaagccattaaactcataaaaattgcaatgcagtcaatgtttgctgaataaaaaattgaaaactgagtagaattttcaagcataaaaataaggaaaacatagcttagtagataaaataatacaataattaaagaattataatatgactgaaaaaaattcaattttctaatcagcataaaacatatagtaaaatagataagttttagaagagaacttaaaagaaaataatcattaataaagctcatagaaataacataaataacagttgttattaagcagttttttataataattatctttgattcattatgattgctgaaagaaaataagattcctataagaataccaataacataattatatatttctagcattataaatactcctttctaaaattttaattttcaagtctttttgatttcttctacttacttgaaattcattgtggtttattttaacagttcctttgttataaatagggtccatatctaaattaataataatattacgattgatttgatagaaacgatcatctaattcttttgataaaagagataaggatttttcagaaagctttattttagaattgttattaagataaatagtagtatcacgtaaactatattcaatataagcaatctgagtaaaatatatatcaaattctttaccatcttttataattgttagatgttctttttttattattctacaaatgatatcgtcaatttcttctaaatggcttttttcaacgaagccaataacatttctattaaaacattttttgatcatttcatcatgacttgaaataaaaatgatatcaaggtgtttatatgataaagattgggcgatatcaataccgctaatattcggcatttctatatctaaaaataaaagttcaaaggaatctatatgattttttaaatcgttataatttgtgtatattgaaatatcaaaatgatatttagacaaataattttctaaacttttacaaaatgaaatattatcatccaatattgcaactctcatataatcacctcactttacaatttaattatatatgatttaaatgaatgaaaaaataccatccatgagtatttaagaccattcattccttaaatgtttattttttaatattctatacataaaatgtaagtagctggccaggaacgatctttacagaacgtttctttgccttatgactatatgatttctttactgtctaggatgatcgttgttggtccatcattgatcagcgagactttcatcatcactctaaagatatacttatttttataaaaaaagaagcctaacattaagttagacttttaaataacatattagagcttctttttataattaaccaatttttttgtaaacatcaacgaattcttgagctaagtcaatgcataataatgatgtcattaagtggtcttgagcatgtaccattaataagcttaatggtgctttttctcctctaatttcagcttgaatcatttcagtttgtgaatgatgagcttcattaactgcttctttagcgtttcctaaagattcttcagctttttcgatatctccagcttttgcatattgaattgcttcgatagctgaactacgtgcgctaccagcattaacaattaagttaattacgatttgttcttgttgatccatttttattatctccttctataaacaaatattcagactacttacatctgcactattattttatcaaagtcatatctattattcaagcgctttcgttagataaagcactattttgaacaaaaagtcatttactacaaataagaaatattcggtaataaaaaaatcttaaatataaaaaggtcccgaaggacctttcgttaaaattattattcaataatttcagagatgtttccagaacctacagttctaccaccttcacgaattgagaatttagttccttgttcaattgcgattgggtgaattaattcaactgttaattctacagtatctccaggcattaccatttcagtaccttctggtaattcgattacaccagtaatatcagtagttctgaaatagaattgtggtctatagttagcgaagaatggtgtatgacgtccaccttcatctttacttaatacataaacttgacctttgaatttagtatgtggatgtactgaaccaggtttagctaatacttgtccacgttgaatttgatcacggttgataccacgtaataatacaccgatgttatctccagattcagcatagtctaataattttctgaacatttcgataccagtagcaactgttttttgagtttctttgataccaacgatttctaattcgtcatttaagtttaattgtccacgttctactctacctgtagcaacagttccacgtccagtgattgtgaaaacgtcttctactggcattaagaatggtttatcaacgtctctagttggagttgggatataagtatctacagcttccattaattcgtcgatagctggagtccatttaggatctccttctaacgcttttaatgctgatcctctgattactggagtatcatcacctgggaagtcatattcatttaataattcacgaacttccatttctactaagtcgattaattcttcgtcatcaaccatatcgcatttatttaagaatacgatgatgtatggaacacctacttgacgagataataagatgtgttctcttgtttgtggcattggtccatcagtagcagcaactactaagatagcaccatccatttgtgcagcaccagtgatcatgtttttgatgtagtcagcatgacctggacagtcaacgtgtgcatagtgacgagtttcagtttgatattctacgtgtgcagtgttgattgtgataccacgttctttttcttctggagcagcatcgattgaagcataatccattgcagcagcttgtccttttttagcaagacaagtagtgattgcagctgttaaagttgttttaccatggtcaacgtgaccaatagttccgatatttacatgcgctttagagcggtcaaatttttccttagccattgttaaggttcctcctatttttttaattttttacaataaacattctagtttatttgttcgaaaaaatcaatatttatttgattttaatgtagattatacatttccaccatttttcttgatgatttcttctctaattgatttaggtgcagcttcgtatctatcaaattgcattgtatagtttccacgaccttgagtaaatgatcttaaatcagttgcgtatccgaacatttctgataatggtacagatgcttgaactgaaacagcatttcctctttcttcttgcccttcaatcataccacgtctagatgaaatatcacccataacgctacctaaatattcagaaggagcagttacttctactgccataattggttctaataatacaggaccacattttttagcagcatttttaagtgctaaacttgcagctactttatatgccatttctgatgaatcgacatcatggtaagaaccatcaaataatgtagcttttacgtctaatacagggtatccagcaatcataccagtttcaagtgcatcttcaagacctacttttactgagttgatatattctcttgggacagccccaccaacgatagcatcaacgaattcaaatcctttaccttcattaggttcaaatttgatccatacgtgaccgtattgtccacgaccaccagattgttttacatatttaccttcacattcagctgcttgagtgattgtttcacggtaagcaacttgtggagcaccaacgttagcttctactttgaattctctttttaaacggtcaacgattacgtctaagtgtaattcacccataccagcgataactgtatctccagtttcagggttagtaaatgttttgaatgttggatcttcttcagctaatttaattaaaccattacttaacttatcttgatcttgtttagtttttggttcgatagctaattggataactggttcagggaattccattttttcaaggataacgaaattcttttcgtcacagatagtatccccagttgttgtgtttttgaaacctacagctgcagcgatatctccagcgtaaacttcatcaatttcattacgtttgttcgcatgcatttgaagaatacgacctaaacgttcttttttatcttttgtagagtttaatacataacttcctgattgacatgtacctgaatatacacggaagaaagttaattttcctacgaatgggtcagccatgattttgaatgctaatgctgagaaaggttcatcatctgatgcatgtctttctacttcattaccatcttcatcagtacctttaattgaaggaatgtcagttggtgcaggtaagaaatcaattactgcatctaacattggttgaacacctttatctttgtaagctgaaccgcataatacagggaataattctacagctaatgttcctttacggattgctgctttaatttcttcttcagaaatttcttcgccttctaaaactttcattaatagatcatcatcataagtagctgcttgatctaacattttagcacggtattcttcagcttgagccatatattcttcaggaatttctttgtaaactacattttcacctttagccccttcaaaatagatagctttcattttaattaagtcaatgattccttcgaaagtatcttcagcaccgataggtaattgaattgcaacaccttgtactcctaatctcttttctaaagattctaatgacataatgaaatctgcacctgttgcatccattttattagcgaatacaatacgaggtacaccataagtagtagcttgacgccaaactgtttcagtttgtggttctacaccagcttttgcatctaatacagttacagcaccatctaatacacgtaaagaacgttctacttcgaccgtaaagtctacatggcccggtgtatcgataatatttacacgatatccgttccattgcgcagttgtagctgctgaagtgattgtgattccacgttcttgttcttgttccatccagtccatttgtgaagcaccttcgtgagtttcaccaattttgtggattttaccagtgtaataaaggacacgttcagttgttgttgttttaccagcatcaatatgagccatgattccgatattacgagtattttctaacgaaaattcacgagccatttgttttctcccttcaaaattttagccgttatattaccaacggaaatgagcgaatgctttattagcttcagccattttatgagtatcttctttcttcttaacagaagcacctgttccgtttgaagcatcaataatttcgtttgctaaacgatcaaccatagttttttcgtttcttaaacgagaatagtttactaaccatcttaaacctaaagtcattcttctttctgaagaaacttcaactggtacttggtagttagccccaccaatacgtcttactttaagttcaagaactggcataatattgttaattgcttgatcaaagacttccatagctgggtttccagttttttcttctacttttttaaacgcatcatataagatgttttgtgcaacaccttttttaccatctaacataatgttgttgataagtttagaaatagttttagagttatacactggatcaggtagaacgtctcttttagcaactcgtccttttcttgacatatatatttcctcctataagtattaattaagcttttggttttttagcaccgtatttagaacgtgcttgtttacgatcgttaactccagcacagtccattgtaccacggataatatggtaacgaacccctggtaagtctttaacacgaccaccacgaattaaaacaacactatgttcttgtaagttatgtccaattcctggaatatatgcagttacttccataccatttgataatctaacacgggcatatttacgtaaagccgagttaggttttttaggtgtcatagtagcaacacgagtacacacaccacgcttttgaggtgatttagttgatgtagcttttttagctaatgagttataacctctatttaaagcaggtgaatttgattttgttgttttatcagtacgaccttgtcttactaattggttaattgtaggcatttctttctcctttcttgataacacacaataccgggtgtttcatatttaatcaataaatattgcacccaatcagggcactgacaatatattatagtattaaaatgataatgtcaacaaaaaaattaaaaaatataaaaaaaataggcctaagcctatttttttatatttgatctccaagattttcatgattatcatctaataaatcatatttagcaagttcagctgcttttgcttcttcagcttcttttgctaatgtttcaggtgattttaaaggacctctaaatcctgtaccagctggtaataatttaccaattaatacattttcttttaatccttttaacatatctttcttacctttaattgatgcatcagttaagatcttagtagtttcttggaatgatgctgcagataagaatgaatcagtttcaagagatgctttagtaatacctaataagattggtctaccaacagctggatgttttccttcttttaatgcttctctatttaattcagtaaattgagttacattaacatgtgttccaggaagtgttccagtatctccaccttcaacaattctaattttcttcaacatttgtcttacgataatttcgatatgtttatcagaaatttcgataccttgaatacgatatactttttgaacttctttaataatataattttcaacagcttctgtatcagctacatttagtaattcttttggatcaatagaacctttagtgattttatcaccaatacgtacttcatcaccaacattaactcttaattttgcaccatatggagttaagtaacttcttgtttctaaatcgttagaaacaacaacttccattcttcctgcattatcaataatatttgatacttcaccatcaatttcagaaataattgatttggcttttggattacgtgcttcaaataattcttgaatacgaggtaacccttgagtgatatcggcaccaccggcaaccccaccatcatggaaagtacgcattgttaactgagtacctggttcaccgattgattgtgcagccataaccccaacagcttcacctaattcaacaacattacctgttgctaagttacgaccataacattttttacaaactccgcctttagcaacgcagccaagaactgaacgaatttcaacttctttaatacctgcatcacaaacaactttagcgttttgttcagtaaagatttcacctgcagcaactaataattctttagtttctggatggtaaacatctttttgtgaataacgaccaactaaacggtcatataatggaacaattacagtattgtcatctgtattgtataattcagtaacaacgaatcctctatctgttccacaatcttcttcagaaataataacttcttgagcaacgtctactaaacgtcttgttaagtaacctgaatcggcagtctttaaggcagtatctgtagaacctttacgggcaccgtgtgttgaaataaagaattctgatgctgttaaaccttcacggaaggcggacttgattggtaactcgattgtttccccttttggatttgacatcaatccacgcatacctactaactgagtgaagttagaaagtgatccacgggcacctgaatcagacatgatgaagattgggttacgatcatcagcttcgaactcttgacgaacgacttcttggacttcatctttaacaccagtccataatttgattacgctttggtatctttctgcttcagttaatttacctttattatagaaagttttaatttgttcaagtttttgatctgctttatcaaagatttcaaatttagcttgtggcacttggatatcataagcagatactgtaataccagcaattgttgaatatttaaatccttggtcttttaacttatcaagcattaaacttgtatcagttaatgcagattgtttgaacacttcatcaatgatgcttcctaatgcttttttacctaatggtttaactggttgttgagcagcaatatgtgctttaatatcagttcccattggaacaaagtatctatcaggtgttccagataagttttctttacctggttcattgataaatgggaattgtccatcaaagatatcattaaagaaaattttacctacagtagtaattaaataactgttattttgagcttctgtaaatgttgcattgtgtaatgcagatgctttaatagcaactcttgtatgaagatttacagttttagcaaaatatgcatgatcaacttcatttctatcagcaaagacagtaccttcaccaattgctccaacatcttctaatgttaagtagtagttacctaacaccatgtcttgggatggagtaacgataggtttaccatctttaggacctaagatatttgttgatcctaacattaattgtcttgcttcttgaattgcttcttcacctaatggtacatggacagccatttggtccccatcgaaatcggcattgaacgctggagttactaatgggtgaagacgaatagcacgcccttctactaatttaggttcgaatgcttggatacctaatctatgaagagttggcgcacggtttaataatactggatgtgctttgataacttcttcaacgattggccaaattttatcatccattttatcaattaatctttcagctgctttaatatttgtagcaatttcttgatcaactaaaccatggataacaaatggtttaaataagcttaatgccatttcacgtggaataccacattgatacatttttaagtctggtcctacagcgataactgaacgtcctgaatagtcaacacgtttacctaataagttttgacggaaacgtccttgtttaccttttaatgtatggcttaatgattttaacgcacgtccaccagcaccagtaattggtttagaacgacgaccattatcaattaaggcatcaacagcttcttgtaacatacgtttttcattttgaacgataatagaaggtgttccaagttctaataattttttcaaacgattattacgagtaataacacgtctatataaatcatttaaatcacttgtcgcaaaacgtccaccatctaattgtaacataggtcttaaatcaggtggtataactggtaatgcttcaagaatcatccattcaggttgattatcagaagatctaaatgcttcaatagcttctaatctcttcaataatttagtacgtttttgtccttgagcttcttttaattctttagatacaagttcaaattctgcatctaaatcaacttgttttaataaagtttgaatcgcttcagccccaatttgagcttcaaatgtatgaccaaattgttcataacatttacgataatctctttcagataatacttgtttgtattctaaaggtgtagttcctttatcaataacaacataagaaacaaaataaataatttcttctagttgttttggtgacatatctaagattaatcccattcttgatggaataccttttaaataccaaatatgtgctactggtgtagctaattcgatatgtcccatacgttcacgacgtactgcagatttagtaacttctacaccacatcgatcacatacaacacctttatatctaattttcttatattttccacaactacattcccaatccttagatggtccaaagattctttcacagaatagaccatctttttcaggcttttgagaacgatagttaatcgtttcaggtttttttacttcaccataagaccattcacgaattttttcaggagatgctaatccaatttggattgatgaaaatttattagtatttgccattttctattccctccttataatgattcactttcttcagtttcaactaattcttcagatttcatagcatcagtaacaacttctttttcttcgtttacatcttctttttcaattgatcttgggaaacgtctttcttcatcttcgatatttctttcatcaatttcttgatcattttcatctaataaacgaatatctaatgctaatgcttgtaattctttctttaatactctaaacgattcaggtaatcctggttctggcattggttgtcctttaacaatagcttcatatgttttaacacgtccaacaacatcatcagatttaacagttaagatttcacgaagtgtataagcagcaccataagcttcaagtgcccaaacttccatttccccaaatctttgtccaccgttttgagctttacctccaagtggttgttgagtaactaatgaataaggtcctactgaacgtgcatgtaatttatcatcaaccatgtgtgataatttaacgaagtacataatacctacagatacaggagaatcaaaatattcacccgtacgtccagaaataacaggttgttttccatcttcattcattcctgcttctttcattaatgcttctaagtcttcacgatgtaaaccatcgaaagcaggagtagcaatatataaacctaattgtctagctgcataacctaaatgtaactctaatacttgtccgatattcatacgagatggaacccctaatggatttaacatgatatctaatggtgtaccatcttctaagtgtggcatatcttcgattggtaagatttttgaaataacccctttattaccatgacgtccagccattttatctccttcagagattttacgtttttgaacgatataaactttaacaacacggttaacacctggttgtaattcatcaccatttttacgatcaaagattttaatatcatgaacgataccagccccaccatgaggaactcttaatgaattatctttaacttctcttgacttttcaccaaagattgcaagtaataatttttcttctgctgataattcagcttgaccttttggagtaactttaccaactaagatatcaccttctttaacttccgcaccaatcatgatgataccatcactatttaagtttttacgtgcttcatccccaacgttagggatatctcttgtaatttcttcaggccctaattttgtatcacgacattcaattgaatattcatcaatatgaatagatgtataaacatcttcttttactaatctttcagacataataacggcatcttcgtagttataaccattccatgtcataaaaccaactaacacgttttggcctaatgctaattcaccttgttccattgctggaccatcagctaatacttgaccaacaacgactttttcaccagctttaacaattggtttatggttgatacaagttcctgcattcgaaatagcaaattttgttaaacgatatttgtgaacaactgcttcatcatccacgatttcaatacgtttagcatctacataacttacagtaccgttatgtttacttactaaagctgctccagaatctcttgcagcttgatattccatacctgttccaacaaatggtgtatgtggatttaataaaggtacagcttgacgttgcatgttggcacccattaaagcacgagttgcatcatcgttttccaagaatggaatacatgaagtggcaacagaaacgatttgttttggagaaatatcgataaaatcaacttcttctcttttagccataatattttcacctaaatgacgggcgataacttgttcatctaagatttcaccttcatcagatgtttgtacatttgcttgtgcaataatgtaatttttttcttcatcagcagttaaataacgtacatcgtcttcatcgataacacatttattaactttacgatatggagtttcaataaatccatattcattgattttagcataagatgctaaagttgaaattaacccgatgtttggaccttcaggagtttcgattggacaaattcttccataatgggaagcatgtacgtcacggacttcatatcctgcacggtctcttgataaaccacctggccctaatgcagataaacgacgtttatttgttaattcggctaatgggttaatttgatccatgaattgtgataattgtgatgacgcaaagaattctttcattgcggcagttaatggacgaatatttgttaaagattgtggtgttactgaatccacttcagataatgacattctttctttaacaactctttccattcttgataatccaattctgaattggttttgaattaattcacctacagaacgtacacgtctatttcctaaatgatcgatatcatctaataaacctatacgagccatatgagatactctatcttcaggtgctaaatcataagaattgaaaatatcaactaagttcaacatatatgaatatgctgcaatcatgtcagagattgtaacatatttacaatttaatgataaatctgtaccaattactttcataactttagtacgtgattcatcaacataaacatgaactacttgcaatacaccattactttctaatcgaggattagttttcatttcaacagtgtgtgcacctgcttcaaaaacaggtcttaatgtatcaataacttcatttgtaataactgttccttttgtacaaacaacgttaccatcaacatctttaacatcttcagcaagaacacgtcctgcaatacgatctaataaacttaattttttcttaaatttgaaacgaccagctttagctaaatcataacgtttaggatcaaagaatctagtatataaaaggcttgtagcaccttctaatgtagcaggttctcctggtcttaatttattataaatttcaattaaagcttcttctgtgtttgttgtattatcttttgctaaagtgttcaaaataaattcatgatcaccaaaaacatcaataatatcttcattactagaaagtcctaaagcacgtaataaaactgttcctgggatttttctattacggtcaatacgaacatttaaaacatcttttgcatcattttcgaactctaaccaagtccctcttgatgggataatactaccttcaaagacagttttaccacttttatcaatggcatcagcaaagtatgcccctggtgaacgtactaattgagatacaataacacgttctgccccattaataatgaaagttcctgaatcagtcattaatgggaaatcacccataaatacttcttgttctttaatttcaccagttcctgaattgattaaacgtaaagtagcacgaattggtgctgcatagtttgcatcacgatctttactttcgtttacggaatattttggttcatcaaaggcacaatcaacaaattctaatgataaagtttcattaaagtttgtaattgggtagatatcatcaaatacttctttaattcctacttctttaaaccatttataggaatttgtttgaatttctactaaatttggtaactctaaagatcctgaaatcctagagtaattacgacgagtaatcttgctttttgctgtagttgtatgcttttccacgaattaactccacccttctttatctctattaaactgtttttgagcgcacaaaaacgcttgattttaaatattaatagtcattattgtattttagataaaggtttcaaaaaagtcaatacctttttttataaaaaataaaaaaagaaatattatctttttacactatgtaacaagtaatatcccttatctcttttaacaatttcacaatttccaaaaacttcttccattttctttttagccgaaggagcgccttgtttcttttgtaaaataacccataaacttccattttcattaagatgttcaattgattcttgtaaaattgtagttacaacttctttacccgctcttactggtggatttgttacgatcacatcataacttccttgaacattttcataaataaagcttttataaatatttgcatgaatattattatttttagcatttaatttggcaagttcaagtgcacgatcattgacatcgaccatatccacatttaaatgtgaataaactttattaaggcatattccgaaagttccataaccacatcctacatcaagaagtgttttttcatttgtaatttcgatatcgtctaataaaacacgtgacccataatctatcatgtttttagaaaaaacaccattatcacttgtaaataaaagatcatatttatgaaatctaaaaataaattgtgattgttcactttttaaatcagtattatctgtaaaataatgtttcatttatatttcctctatttcctttttctttattatacaaataaatagaatgttaaccaataaaaaaaagaagaatcgtaagatccttcttttaaatcaaagttataattatttaacttctactgtagctccagcagcttctaatttttctttgatttctttagcttcatcagcagatactttttctttgattactgaaggtgctttgtcaactaatcctttagcatcaactaatcctaatccagtgatttctcttacagctttgattacagcaactttagttccaccaacttcagttaatgttacgttaacttctgtaggttcagcagcagctccagcatcagcagcagcagctacagcaactggtgcagcagcagttacatcaaatttttcttcgattgcttttactaaatcatttaattctaaaatagtagcttcttctaagtaagctaagatatcttcatgtgttaattttgccatgtttatattctccttttcattaattctgcttattcagcagcttcttctactttttcttcagcaggtgcttcaactggtgcttctccaccattttcttctcttgcatctgctacagcttttacaactctagcgaatttgctaactggtgcttgtaacataccaagtaacattgagtacattccttcacgtccaggtaatttagcaatttcattaatttcttctacttctaatacttttccttcaacaattccagctttgattactaaagcttcatgatctttagcaaagttagctaaaattcttgcaggtgcaacggcatcactatgaccgaatgcaatagcgtttggacctactaatttatcattgatttcagcatatccagcgctttcagtagctctttgaactaatttgtttttgtaaactttgaattcaacatcttcttcacgtaatgatttacgtaattcagtgacttctgctactgataatccacgatattctactactacagcagattgtgaatcattaaatttaccagcgatttcttcaacaacgacttttttcgcattgattgcttctactgacattgctacacctcctataaatttttatatatgcaacaatatacgcgctatatttaaaactcccatacgtagataggagttcaagttcttcataaactcaacacctcggtaacaaattaaggtttcccagttactgtctacggtatattgattgcgacattttttacaaactatttagtagtttgaactttgattgcaggtcccatagttgatgaaactgcaatatttttaatataagtacctttagctgatgttggttttaatcttacgattaaatcataaattgtgttgaagttttcaactaatttagcatcatcaaatgatactctaccgattggtaaatgaacattaccttctttatcagtacggtaagttactttaccagcttttgtttcttgaactgctttagcaacatccatagttactgttccagtttttgggttaggcattaaacctttaggtcctaagatacgacctaatttacctaattcagccatcatgttaggagtagcgatcataacttcgaaatctaaccatccttttttgatgtcttctaaaatttctttaccagcaacgatatctgcaccagcatctttagcttcttgagctttttctccttcagctacaactaaaacttttttagttttaccagttccgtgtggtaatacaacagctccacgtaattgttggtctgcttgtctaacatctaatcctaaattgaaagcaacatcgacacttgcatcgaattttacattacttgtttttttaactaattcaatagcttcttcagctgaataaagttttccattttcaattaatgcagctgcttctgtatatcttttacttttctttgccatttaatttcctccttagtggttataacggattatccttccacgtgatgcttacgcatcgattccttcaacttttacacccatgtttttagctgtaccagcaacgattttcattgcagcatctaaatcataagcatttaagtcaggcattttgtattcagcgatttcttttaatttatcagctgataatgttcctacagtagttgttcctgcattactagaacctttttgtactcctaaagcttttttaatcatttctgaagctggagcagtttttaatacaaagctgaaatctttgtcttcatatactgttaagacaactggtactgtttctcccatacgatctttagtttgatcattgaaagcagtacagaatttaggcatttggatacctgcacctgctaatgctggaccaggtttagcttgccctgctttgaattgaattttcataactctaacaactttcttactcacgcgacatttcctccttgtaaaaatttgtccgtgttgtggtcaaatgggtgttacccttccacacaacaatgaatgcgcaattagcctattgcgtcgacaactaatttaccattatctcttgataaatgcaatacttttttatattttttttgcattttatcaaataaatttaaaaaaaagaaaaactctaggaattttcctagagtttaaacaacaattagtctaaagcagcaatcattgctttgtatgaatcttcaactaatgaagctccaccaactaaagcaccatcaatatcaggttgttctaataatgcttttaaaccttcaggtttaacagatccaccatattgaattcttacttgatcagcaacttcttgtccatataattcagcaactactgaacgaatatatccacaaacatcttgagcgatttcgtttgtagcagtttttccagttccgatagcccatactggttcataagcgataacgcttcttgaagcacatttaggacatacatctttataagcagcaactacttgagttttaacaacatctttagtagttccagcttcatattgttctaatgtttcaccaacacatacgattggagtcatatcatttttaagaacttgaagcattttagcgttaactgtttcatcagtttccccaaaatattgtcttctttcagagtgacctaagataacccattcaactccgatttcttttaacatttcaacagatacttcaccagtataagctccgctatctttgaagtgtacgttttcagcagctacgattaagtttttagctcctgcttttgcagtttgtaaagctaagtatggagtagcaattccccagtcagctttatcagttacttctggatcaacagcttctacgaatgcttttgtagcagcgattgttttattcattttccagtttcctacgataattggttttctcatgattacaaataccttccttattatttatcatcaattgcagcgatacctggaagaactttaccttccatatattctaatgaagctccaccaccagttgagatgtgagaaactttatcagcatatccaagttgcattactgcagcagcgctatctccaccaccaatgatagtgttagcaccttctaaaccagctaaagcttcacatacagcgattgttcctttagcgaatggttccatttcgaatacacccataggtccattccatacaactgttttagcaccagctaaagcagctttgatgttttctacagatttaggtccgatgtctaatcccatgtatccgtcaggtacatcttcaccacaaactttaatatcaccttctgcagcaaatgcagtattgattacagaatctactggtaagattaatttatctccagctttagctaagatatctttagctacgtcaattctatcatcttcaactaaagagttaccgattgaatgaccttgagctttagcgaaagtatagcacatacctccaccaacgataactttgtcagcaatttttaataagttttcgataactaagattttatcagaaactttagctccacctaagatagcaaccattggtctttctggattacttacagcttttccaatgtagttgatttctttttctactaagaaaccagctgctgatggtaaatgagcagggattccagctgtagaagcatgagctctatgaactgaaccaaatgcatcttcaacaaatacatcacctaatgaagcccagtattttcctaattcaggatcatttttactttctccagcttcataacgagtgttttgaactaagataacttgtccattttcagcgtttttaacagcttcttctaattcagcaccacgagtgcaatctacgaattttacatctctacctaataattcagctaatctaggagcaacaacagctaaattgtttttagctttgtcttcttcagttttcactttacctaagtgagagaataaaacgatagcttttggagattgttctaataaatatttgattgttggtaatgcagcaacaatacgattatcattagtaatttctcctgtttctttacttcttggtacgttgaagtcaacacgaactaaaacagtttttccagcgacttcaatatctctaattgttttcttatccatttttataattcctccatggctgaattatatcatctataatcattgttttcaattaatttcatattatattatgaggtgaaaaatatgaaaaatacgaatgtaatccctatccaaaaaatcccatctatgttagagaatgattatcaatttgtcgatttaagagatccctatgagtataagaaagttcatctgacaaaattcacaaatattccctatgaaaagttcaatctcaatcaatattatttttctaaaaaagaaccacttattcttatttgttatagcggagctaaatcaaaaaaactcgctgatgatctatgtcaacaaggctatgatgcttacagtattgaaggtggattctattctattttgcatcaaaagacataaaaaaattaacgggtgtatactcgttaatccaatggtttattataaaaacgtccaataaagttttcaactttagttacagaaacaataattttaggatctgtttcttttaaagcttctaaaacatctccaacttcataacttgatacaactgctgttaaatagcttacaggatgatgtgaatatcctccataaccatctaaagcagtaatcccatgatggaatttttctaaatatgtatccaccacttcgtctttttttgcagtatagatgtgtaacataactcgtttatatcgtgtatggaaagtagaaattgtttttgttgagataaattggaacaaaatagaataccctgctttatcaaatccaaaaataactccaaaaatacataaaatcatagcattaaatacaaatacttgcatccagatttctcgcccatttttattagcaaaatataaagcaataaaatctgtaccacctgaagaagcacctgcttttaaagcaagtacaatactcattccccaaatatatccaccaaatacaacatttaaaacttgttcatcaaataatggataatttggaatgatttgtaataaaaatgatgttaaaaagacttgtaataatgaaaagaatacaaatcgttttgatattttcttggcacaaataagcgcaacaggtacatttaaagcaactaaagtgaatgctgttggaattgattttccaaataaatcagcaatcatatctacaagtaaggcaatacccataaacccacctgacaataagtgtgctggtcttacaaatgttttagttgtagcagccataatcagcgaagaacaaaagacacatccaaaactaattaaatctcttttttttatctttttcataatctttctccctaaattccactacattgtactcttttagaaacaatttacaacaggcaattataaaaaaataaagttaatttattaacaaagaaaaaggattaaattcacatctaatcctcttatctattctttccatttttatgataaatattttcaaaaaaatcatacaattttaattcatcttgttcaaagaagtcaatcacttcatcacttgcttgaatatcaatattcttatttcttaatatttgataagccattttaggattttcctcaactgattttcccatatcaatgataaattcaaatccatcttgaaagataaaactaaattgcatcacataaaatgtatataatccctgatgtcctccaccaccttttgtaaaataaagtgctaattttactcttcttaaatcttgccaactatattccttattttcattattttcttttttagttatcaagctttttaaaatagattttctactttgatagtgataactacaaattgaaatcttattatctgttaattcaacatatcctaatttagtttcacaaataacaaatataatcaaaagaataataaatgaaatacacatagaaaaaatgatgagtttccctgatgctttataaaaaggtatttgaaaatgttgtactgaacttcgtgtttgttcgttcacataagaaatcatattaggaaatgctaaaccaattaaaattccaaaaattccagatataaataaagataaaacactaatgcctaacagacttcttggtatcgacttataaccaataactactgtttgatctttcttaaaataatcaaatactttctttaaatcttttttcttaactttttcattccctatttgattaccttcaattacttgatctaataatgggatattcttctcttttaaatcttcacacatgttttttatatattgtaatgattctatttcggtatttaccttttgaatatgactttctaagacatcttgaaatgtaactttattatttaagatatctttaatatcttctataggtacattgatatctcttaaaaacataattctctctattttgtgaatatcttcttcactgtaatttcgataaccattttcatcacgataaggttgaatgagtcccatcttttcataatatcttagtgtataagaactgatttttagtttttcttgaacttcttttatttgcataattttcacctaccttcattatttcatacattcaactaaatagccatcatcctttaataattggataattccttttttaccatagagatgtttacatcctacacctataaaatcatgtttattattatgaatactatcggctaaagtatctttcatatgaatgtttctactatatgcaagtatattccaatacttttcatacttttctttatcactatcatttaattgttccaactgatttaacaataaattttgttcatcttcataatattgtgtattaccactataataagcatctaaatcttctttagcactttttattaccatttctttatttgctaaattatctaatatcgtctctgagtaatcccctgataattcagttattagcttcatttgaaattcaataccttcaacttctttaaaattctttttcttttgagcatacttataaatataattatcaattgcactaaatttacttatatttgccttattcaatacttcaggatcactatttacaagtgagtttattacaaatacattatagagtgcataaccaggttttcctttcaaacttttgtattgtttcataagattttcatatttatcttctagacctaaatcacgaattgaattgtacgtattgtatttagtgatttcttctgtttcttttggcgatggtttcatatcacattccaaataaatcgaatcactttcatctaatactttctctgttgttttatctaaacttttaatgggatatcttcctggatgacatgttccaaataaatatgaataatttccttcttgattagatactttatataaaaacatacttgtatctataacttttgcattttcttctttcttttgtattgcacatccacttaccattactaaaacaacaagtatgattatttttattaactttttcatcttatttcccttctttctaactaaaacatacacgttagagcagctagaaggtcaatataattcaataaaaaagaccaaatatttctatttgatcatttaataattatttattttttaaatctgtttcatcaaatgctttagaaatagcaccacctggagcaaccattgggaagactttatcatctttaccaatcattacttcaattaaaacaggtccatttgtatctaaggcttctttaatagctggagccacttcttctttagtagaaacacgaattgctttacatcctaatccttcagcaactttacagaaatcaactttatcatctaaaatcgtattactataacgtttaccatagaataatgtttgccattgtcttaccattcctaataccttattgttgataacaacttgaataataggtacattgtaacgacttgctgtagcaagttcattcatattcattctgaagcatccatcaccagcaatattaaatactgggaaatcaggatttccatacttagcaccaatagcagcacctaaaccaaatcccattgttcctgcaccacctgatgtaattaattgacgaggtctacgataatgataatattgtgcagcccacatttgatgttgtcctacgtctgtacaaatgattgcattactatctgttaagtaatcaatttgttcaatgacataaggtcctgtaagagttgattcatcataagttaatggataacgatcttttaaatcacgaatttgttttaaccattgaggatgattttgtctttcaagtttattatttaattcacttaaaatacatttagcatcaccaataatacctaaatcaacttgaatatttttattgatttcagcagcatctacatcaatatgaataattttagcatttgaagcaaatgttttagtattaccagttacacgatcagaaaaacgtgccccaattgtaattaataagtcacattgacttaccccaaagttacttgctttagttccatgcatcccaagcattcctgtataacgaggtcttgtattatcaaaagcccctttacccattaatgtttcacaaacaggtgcatcaattttttcagcaaattcttttaattcttgacttgcaccagatgaaataacaccaccaccagcaaaaataaatggtttttcactttctttgatcatttcaattgcttgatctaaatcttcaacagtatatgtttcaattttaggttcaatagcttttggttgaagtgattcaaattccatcttttctgcagtaacgtttttagtaacgtctactaagacaggtcctggtctaccttcttttgcaatatagaatgctttacgaattgcaggcactaaatctttaatatctttaacgataaaattatgttttgtaatcggcattgtcacaccagtaatatcaatttcttggaaactgtcacgtcctaagatttcaacaccaacatttgcagtaatagcaacaagtggtgttgaatccatataagccgtcgcaattccagtaacaaggtttgttgcccctggtcctgaagtagccatacaaacaccaacttttcctgttgctcttgcataaccatcagcggcatgagaagcaccttgttcatgagaagtcaaaacgtgattgattttatcttgataacgataaagtgcatcatagacgttaagaatagttcctcccggataaccaaacactgtatcgacaccttgttcaattaaacattcacatataatttctgaaccagttaacatcattttgtttttcctccttttattttttttcttctggtgcttgtaataccgcacctttatctgcagatgttactaaagaagcatatcttactaagtaaccttttttaatacgaggttctcttggttgccatttagcttttcttgcagccatttcttcatcacttacacgaacattcattgaatgatttaaaatatcaatatcaataatatctccttcttcaatgaaagcaattggtccacctaaagcagcttcaggtgccacgtgtccaatagaagctccacgagtagctccagagaaacgaccatctgtgattaaagcaacatctttatctaagcccataccagcgatttctgaagttggtgataacatttcacgcattccaggtcctcctttaggtccttcataacgaataacaacaacatcacctttaacaatttttccttcacgaatagctacaatggcatcatcttcacagtcaaagacacgcgctggtcctgtatgtaccatcatttctttagcaaccgctgattgctttacaaccgcaccatttggacaaatatttccttttaatactgcaataccaccataaggtgaatatggattttcaactggacgaataatttcaggatctaagttaacacatccttcaatattttcagcaacagtttttccagttactgttaataaatcagtagataataaacctaatttattaatttcattcataactgcataaataccaccagcttcatttaaatcttccataaatgtatcaccagcaggtgctaagtgacataagttaggtgttttcttagaaatttcattagcaatttcaagatttaattcaactcctgcttcatgagcaatagctggtaaatgaagcattgagttagtagaacatccaagtgccatatccattgttaaagcattggtaaatgctttttcagtcataatatcacgaggacgaatatcttttttaattaattcaacaatttgcatacctgcatgtttagcaagtctaattctttctgaataaacagctggaatagttccgtttccacgaagtgccatacctaaaacttcagttaaacagttcatagagtttgctgtatacatacctgaacatgaaccgcaagttggacaagctttttgttcaaattcatgaagtttatcttctgtcatatttcccgcattgaattgtcctacagcttcaaataatgaagataaacaagttcttttaccatccattttacgaccagctaacatcggtccaccagaaacaaagattgttggaacattgactctggcagctgccattaataatcctggcacgtttttatcacagttaggaatcataactaaaccatcaaattgatgtgcttcagccattgcttctgtactatcagcaattaattcacgtgttacaagtgaatatttcattcctgtgtggttcatggcaataccatcacatacagcgattgccggaatttctactggtaccccaccagcaagatagattcctttttttacagcttcacaaattttatctaagttcatatgtcctggaacgatttcattgaaagaattgacaaccccaattaatggtctttctaattcttcatctgtatatccagcggcattaaataatgatcgatgaggagctctttcagttcctttttttacaaaatcacttttcatccctatatcctcctataaatgacttacaataaggtctcccatttcacgagtccctactaatattttaccttcagacatgatatctgttgtacgatatccttcttttaatactttttcaatagcatcttcaacatcttttgcttcttgatctaaatcaaaagaataacgaagcatcattgctgctgataagattgtggcaattggattagcaatattttgcccagcaatatctggtgcactaccatgacttggttcatacataccaaaactatcttctcttaaagaagcacttgataacattccaatagaaccagtaaccatacttgcttcatctgataaaatatcaccaaacatattttcagttaaaatgacatcaaattgttttggatctcttacaagttgcattgcacagttatctactaacatatgttctaaagtaacttcaggatattctgtagcaacttcttcaacaactttacgccataaacgagaagtatctaaaacatttgctttatccacgcttgttacttttttatttcttttcatcgcaatgtcaaatccacgtttagcaatacgacgaatttcaacttcactataactcattgaatcatgagcaaccatttgatctccttctttttcagtagaacgttcaccgaaataaagaccacctgtaagttcacgcatgatcatcatatcaaatccaccttcagttaattcttctttaagtggacaagccccttttaattcatcatataagtaagcaggacgtaaatttgcgaataatcctaattcttttctaatttttaataaacctgcttctggtcttaatgatggttctaatttataccatggcgaagttgtcgtatttccaccaatagcccctaataaaacactatcactttttttagcaatttttaaagcttcatcacttaatggtacaccataagcatcgattgaacaaccacccattaagatttctgtataattaaatttatgattatatttttttgcaacagcatctaaaactttcatcgcttctgtaacgatttcaggcccgattccatcacctttaataaccgctatattcttttccattttttatcccctattttttagaatttacataatttactaaaccatcagcatcaatcattttttgtaagaattctgggaatggttgactttggtaagtttcattttttgttttatttgtaatcacacctgttgaaaaatcaacttctacttcgtcacctttttcaattttatcagctgcttcttcacattccataattgggaatccaatattaatagaattacgatagaaaatacgtgcaaagcttttcgcaataacacatttaattccagcagtttttaaacaaagaggtgcatgttctcttgaagaaccacaaccaaagttttgacctgcaacaataatgtctcccttttctacagttgaagcaaaagtaggatcaatatctgccattgcatgacttgcaagttcttttgcatcaaatgaatttaaataacgtgcaggaataattacatctgtatctacattatctttatatttataaattttcattattctttacctaccttttcaggatttgcgatatatccagcaatcgcacttgctgcagcaacttgtggagaagctaaataaataagtgcttctgtatctcccatacgtcctacgaagttacgatttgttgttgaaacacatttttcacctttagccataacacccatatgaccacccatacatggtccacaacttggtgtattgaatgcacatccagcttctacaaagatttcagctaagcctttttgaatacattgtaagaagattttttgtgttgctggtacaaccattacacgtacattatttgctacttttttaccttttaagatagcagctgccttttctaaatcagataaacgtccatttgtacatgatccaataacaacttgatcaatatagattttatccatttcttcaatttcatcaattgtatgaccatttcctggtaaatgaggaaatgctactgttggtctaacttcacttaagttaatatcaatcacttgttcataaacagcatcatcatctgcttcaaaaacttcataagtttttttagaatgtttttcaatgtaagcaattgtttgatcatcaacagggaaaataccatttttagcccctgcttcaattgccatattacaaattgtaaaacgatcatccattgttaaatattgaataccatctcccacaaattccattgatttgtataaagcgccatcaacaccaattttatcaataatatgtaaaataacatctttcccactaacatattcacttggtttaccagtaatcacaaatttaattgcacttggtactttaaaccataattccccagttgccattccagtggcgatatctgttgttcctacacctgtagaaaaagctcctaatgccccataagtacatgtatgactgtctgccccaataatacattcaccagccacaacgattcctttttctggtaagatagcatgttctacaccacatttaccttgttccatacgatgtgttaaacattgtttgtttgtaaaatccaaaattgcttttgaattttctgcagatttaatatctttatttggtgtaaagtgatctggcactaaaaccactttatctttatcaaagactttatctgccattttatcaaaaattggtaatgccattggccctgtaatatcatttgccattacaacatccaattttgcttcaattaattgtcccgcttcaacatgatctaatcccgcatgttttgctaagatcttttgtgtcattgtcattgccattttttaaattcccccttcatttttaaccttagtaggttgtcattagaaagtcatgactttccaatgacaacacactaaagtgtgttgattagttattgattaatttatcttcatcagaccaagaataaagttttctgatttcttttccgactttttctgattcatgttctgcagctaattttctcattgctttttttgtgcaacaataaaacaaacaggacattttcttcattatgaaggcttactgtttgtttttttattctatgattataaattgacgcttaccgccttaatcatagtatccatattctgtgtcactcatcaaatattcatattccgattcatgttcttcatctctacctgctttatattcatagctaaaaataatgactttatttttatctacaaacgttccataaacaagtccaccagcttttttattatttttgtttttaaattcatatctatatcctggtttatccgtattatctgattgataacttctctttttgatgttttcttctgtattataattttggtatatttcatcttttaaaaatgtataagcttcttttcttgtagatatagtttcaacatctatggcttttaatgtaattctattatttttatctaattgataacaatgataatattcattcgagtcactactttgtttatattttaatggaaacatatatgatatatgatctatttcataatgattcatttctattttctttaaaccacatccagtaagtaatacaactaatagtaatataataatctttttcactttaatcacctagatcctctatatgttgtaataattttattttttgttactacaatttgatagtctttatttgtataagtatttccttttttcttaaatgattttattgcttggtcatagtttttgtaatgaattttatttgtatcaaattgataagtataatcatcatttaaaaattgaatataagcattattttctcttgtttcataatcagtaagtataataataaatttaaatactccatttttataaatatcatttttaatagtgatatttctttcataataaataatttcttgattttttactttttttatacagtttgtagttttagttttaaccgcttcactttcataaagatcatctattttttcatatgtttcatattgttggttattttgattcgtatttataaacaaacataaagtaagcattgctataaaaaagtatctcatttgttttgtattgaattttggacttaacttttgcaatattccaataattataataggaataaaagtcatgtaaaaaacattagcacttaataaagaagttaaaataatatctattaaataaataatagaaatgataaaaatcaaataatctttaattccatttaatttctttaatatcttcaaatccttatcatgttttaaagcatataaaattgaaaaatttaaaattgacgataataaaatacctatagctaaaataaagaccattaacaatataaggtatttagtaaatccttcataataaacaattggaaaaccaatttcaaagaaatcagttaaaaataatttcccaatccaaaataagaaacaagctaatattggatatacaaagtatctcatctttttaaattgtttgatcttattatttttatcaaatacaaattctgtatttaaatctggcgcatctacatttctattttctaacactctaaaatcaggcaatgcattttctacatcatgatatcccatttccttcaaaacttcattatattcactagaggatggagtgtaatctatttgatacttataaacatgttcatcatgactaaaacgataataatagcctataaaatctaaacgccaaccttttttagacatcttattaaaatattcttgtaactcttcatctaaatacaaactatttcttaaaacatatttgtgtttcattgtcttatcctcccttattatttgtatcttgtaataattctattttttaatactttgattacatatgttccattgtcatatgtatttccttttttattaaaggattgaatagctttttcataatgaacatattgtgttttattactgtcccatgaaacattagattttgtatttactgctttttcaaaattttgattatctcttgtatcatgttctgttttgataatgatgtatttaaagatttcatctttatacttatcttttttaatcaagacatctaattgtggataggtgcatgttgtatcttttatatctttttcataatttgtaatttttgttttaacagtgctactttcaaataatgaatcatccatttgtacctgaggaaaaataagtccacaaatagcaatagctacaaaagcagcaatggcactgttatatttattatttttaataatacgtgataaaactactcctataatacatgtaagtaaaagataaacaatgacttttaaatctaatgttataaatgatttcaataagtaaaaaacaccacttattaataacaaaatataaaatagaatacttaaatggtctttaatactgtttagtttctttaagctttttaaatctttatcattttttaatgcatataaaatagaaaaatttaaaattgtcacaaataagagtacaaatgataaaataataaaaacaatacccatcaacaatgaaccaaatccttcataataaagaacaggtttacctatctctacaatatcttttataaaaatcttacctaaccaaaataagaaataagctaaaattggataaataaaatagcgaatctttttaaattgtttcattttattatttttatcaaaaacaaattctgtatttaaatcaggtgcatcaacattttcattttctaaaactctaaaatcatcaaatgaatttcttacttcgtgataccccatttcctttaaaatatcttgatattcactagatataggggtgtaatctatttgatacttataaacatgttcatcttttacaaagcgataataataactaacaaaatctaagcgccaaccttttttcgacatctcattaaaataatcttgtaattcatcatctaaatacaaactatttcttaaaacgtatttatacataatcttatcctcctatttgatctaataatgaaatttgtttaagcatcctttctttttctttttgtaatttctttttccctagattagttatttgataaatctttttattattttctacttttactaatttgatataacattctttttcaaactttggtaataaagtatataaggaacctgctcctaccgtaacttctccatgcgtaatttcagtaatcttattcataatttcataaccatgcatcggttgatgtaaaacaagtaagacataatacatttgtggagtcagtacttccatttctctttttggcatctatatcatctcctatatcgtttaacgatactttcttcacttttattatatatcgttaaacgatatatagcaacaaaaaaagaacacatgttatctcaacatgtgccttttctttgtttatattaaggggaggttttcttttacacccttataataatgaatctatgttaatttattgtgaacttttagttcttcttttaatttttataggtttgttgacaacttcatgacaatgtctgcatcttggttcataatgatccactgcacctactaaaacaacaggatcatcgaaagatgctggcttaccatctacaagtctttgtgtacgtgtagccggtgagccgcattttgcacaaacagctgtaagctttgtcacaaattctccttttgttagaagttcaggcataacaccaaatgcttctcctctaaagtctttgtctaatcctgcaaccatgacacgaactcctttatctgcaagatattcacatacatcaacaattttttcatcaaagaattgcacttcatcaatagcaacaacttgaacatcatctgttactttatctaagatttcttcaggatcatcaattgcataacatggtacttttctacctgaatgtgaagcaatttctatttctgaataacgatcatctatttttggtttaaatactaatattttttgtttagcataagataaaacattaattctacgaataagttcttctgttttaccagcaaacatacatccacatataacttctatatatccttctcgatattggtgatacattctttcttctcctaacctcttacatctcttacacccgcactacttccatcaggaccaataggtgctaagtctgtaaatctactaaaattcttttcaaaagcaaggttaacttcacctgttgctccatttctgtgcttagcgataataatttctgttaaaccattatcttcctcttctttaccttcactagctttataatatccttctcgataaataaaggtaacgatatcagcatcttgttcgatggctcctgattcacgcaagtcagacatcattggacgtttatttggtctttgttcaactgaacgtgataactgtgataaagcaataacaggaacatctaattctctggccaacatttttaattgtcttgaaatatctgagacttcttgttgtcttgattctcgattattggaacttccagtaattaattgaagataatcgataacaattaattttaaaccatgttcttgttttaattttcgacatttagcgacaatttcattgattttaactcctggcgtatcatctatatataaattacatttactgactctttcagctgccgcatagtatttatttgcatttgttttcaatatttcacctgttctcatggtagaaccttcaattccacccatggaacaaataattctttgtactaattgactcgcaggcatttctaatgaaaaaatagctactggatcttctgatttaaaagcaacattatgagcaatatttaaggcaaaagctgttttccccattgctggacgtgccgctaaaataatcaagtctcctttttgaagtcctgatgttattttatccaaatctctaaaatttgtacgaatacctgaaatattaccatcaatactttgtaatttatttaaacgatccgttacttctctaataactttttttacatcgacgaattctccggcattacgatctctcgtaatggccaacattgttttttcactttcatcaataaaaccatcaatatcttcaatatctccaaaagcattttcagctatttttgttgtttcattgatgatttttcttaaaatcgatttattatgaataatctttaaataatattcactatgagctaaagttggaactgaatcacttaattgtcttaagtattctactccacctactttatctaattggctatgatctaatagataagaagtaatcgttgtaacatcaacaggtatattttgtctcgaaagttcactcattgcattgaataatactttatgtgattcttcataaaaatctctatcttcacacttattcaaaatatcttggcaagcttcttttgatataagcatagatcccagtaaagaacgttctgcctctaaatcatgtgggaaaactcttggcataaatctccctcctatttttcagataagtgaactctaatagtagcgataactcctttgtatagttcaacttttaagtttgaatatcctaatgctccaattggatgtgcattgataaattttcttttatcgactctaatatcatatttttctcttaattgttcaacgatatgttttgttgaaacacttccaaatgttttaccatctttaccagattttaaaacaaattctaatgtaataccttcaattttttcttttagtgcttccgcatttttcttgttttcaatatcttgtaatcttgcttcttctttttgttgttctaaaatctttttagcacctgctgtttccttaacagctaatttatttttaattaagaagttttgtccatatccatcagatacattgacaacatccccttttttacctacttttctaacatcttctaataaaactactttcatcttttttaccctctttcatccaaatattgatcaatagcttcttctaacttatcgatcgtttccttaacagttttttcttcaacctgacaagcagccattgaaaaatgaccaccacctccaagtttttccataatcaattgtacattaacctctgccttagaacgagcagaaatagcaatcttatccttatctacgcgtcctgcaacaaataccgctttaatttcagcaatatttaataactcattaccaactttcgctagtagaggtcttgtataaatttcttcttcatttccatatgctattagtatatcatttccaaaacgatatgcattagctgaaatagacattttttcttgtgtcgttttgtaatcatcttgcaagaactcataagctctagaaacattcgcttgtttttctttaagctttgaagcaatttgaaaagtacgtgatccaacatgatttctaaaatagtttgtatccaccaacattcccgcatacataacagttgcttctgttggtaaaacttcaatttcaactctttgatactcaaataattcaaccactaattctacagttgaagaagcagctggttccaaataagttaaaattggtgaatcaacaaagtcttcccctcgacgatgatgatcaatcacgactatcttttcagccttatccaaaagttcttcactaatagccaatgctggcttatgattatcaacacaaataagtaatgtatcttcatcaattaaatcaatggcttttgcaggagaaataatttttcctttatataaatcctctgccattaaacgacgtgcaatatttcctgttttttcttctaaagaattttcatcaacaatcacataagcatccttttcaaatgctttagcaaatttagcaaccgctaaacttgctccaaaagaatctaaatcagattgtttatgtcccataataaggatattttggctttgttttactatacttgctagtgtttgtgaaataacacgtgctctaacacggttcgctttttcactattttcactatttccaccaaaatatcgaatttcttcatctaatgtttttactgccacttgatctccaccacgtgaatacgataaagaaatagcactaaaagcaagttcatctaattcacgtaaaactttagatcctcttcctattcccattgataaagacatcacggcaccaattgattccatcttttgtttaaattcatctaaaatacaaaaacgaacttctacttgtttacgataaatcctttcattaaaaacagctaaataaccatcttctttatatctttttaagataattccattatctttggcccaatcaaaaatcatttgtcttgaagttgtttcaatcatgactgatttttgttcatctgcatattcaatagaatcatcataattatcaattgttaaataggcaacacataattgttgatcattatattccttttcaatcgttgttaaatctgttacatcttttaaaaataataaacgattatttctagaattataaacttcatattttctagaattaatatctattgttctaacatcttcatcttcaaaaagtattgcgagtaaaggttgccattcaagtaatttcttccctacgatacgaataccaagttcatgtaataaatcactgacccaaacaacatttctattttcatcatatttaataagccctattccaccaaaaatcaaagcattctttgattcattatttaatgcttctttaacactataagttgtttcactaaacatattatggagataatagagaacaatgatacaaacaacattttttattaaaatataaatcattaaagctaaagtaacacgattttgtaaaaacatataagttaataaaactaatacaaattctatacctaataaagcaactattgtatttctaagttgcataagcttcttaatcatgaaataccctcctctttattaccttatattatacatgaattcatttatttcatcatcttatttttattcattcgaaggataaatagattcgtgtaaactttaataatataaacttctgaaaatgataaaacgatccataaaataataaacattccattctttaaaaaatcactttctaaaaaaggaaaaacacctacaatactataataaatatcttttgcatctgtaaaagtatttaaacctaataaagaatttaataaaaataaaacaatataattcttcaacatactataaactcttaaaatccatttaccatcaatcttcttttttatacaataaatatataaaatacctaatggtaaagtaaaaaaagaatacaaagtaaaaaatagttcacctgttaaaaataaaataaacgtacttgtaaacaagacaagaacagccatcttttcattaaacttaaacgtataataagctaacgcaactgtcattagataaataaaaataatatcaaacatcgttcctgtataaacatttacaactgataacactccaaaaagagctgccataaatgctcctgttacaatttgttttgtcttttctctattcatttcatcaccgtgattatcatacaactttatcgcttatctgtcacttatataaagaaaaaagagattccttagaatctctagtcgtgaactactccgacttacacttcgtttagaagtcggagcttcttgcttcaaccagttgcaattctttttaacatttcatcttcaaatggattatatcttcctccacctaatggtgcccatgcttctggaataacattataatatttcattgtttccaaagctttttcttgagtgtaataaggatgtaattctacttgattgactactggttttactttaacaacttcacagaagtttgtaagaatatttggatagaagttagaaacaccgattgcctttaatttaccttcttgataagcagtttccatggctctccaagaactgaaataatcaccacaagcttgatgtaataaatataaatcaaaatattctaaaccacttttttctaaagaagcttcaattcctttttgggcactttcgtaatccatcatatcttgtacccataatttagaagtaataaataaatcttctcttgtacaaagaccatcagcaattgctctttttacagcagctcctacagcatcttcattataataagcagcagctgtatcaattaaacgatatcccgctttaattgcttgataaactgattcttcacattcttttttatctggtactctaaaaacaccaaaacctaccattggcatttttaaaccattatttaatgtaacatattccattatatgaccccccttttgcttatattttaaatcatctatataaatcttcaaatacttattaactatcatctatcatacatttaaagcataaaaaaagaacctctcggttctcctctattattttttagtagtttttttagcagttgttgcttttttaacaactggtttagcttctttagcagctacagctttagctgcaggagcttttttagctggtgctttttttgcagctggttttttaacaacttctggatattcaggcatagcattaacatctaattcaccttttaattcagaaccatcttttttaattgctacaaagaaaactttagcagtttcaggtaagtaataaatatttaaagtttcaacttctgttgtttttacaccttgttcttttaaagtttctttaacgtatttatctaaatcaccatctttaacattcttttcttggtattgtacttcgatcattgttttcatattctctcacttcaaaacctcagtttttacttcctccttggtaagtattctataccattttttttatttgtaaagtgtttttcttaagaaaaagcgcatgaaatcaacgtttttctctaattacttatcatagtaataaaatattgttttatcttcaaaccttttatcttaatttgtaaaaaaatagaattggaaatccaattctatttcttagattttgaatcaataatcatgataaatttagttttagcttctacaccatctttactatctgcaaatgttttataatcattagctaaatcaacaagtttttgtgttgtatctacatcttttttcactgtatcatttaaaacactagaaatcttatctaaacctttacttttaaataaagttaaaccatcaactaaagcatcactaccttgagctaattgatttgatgccgtttttaattgactacttgcttgtactaaagtatcagatccatcacttaatgaagataatccttcacttaattgtttagaaccatcaacagcactcttagctccttcttttaattgagcaactccatctgtataactttgtaatccttgatagaatttgttatatgaatctaattgtgctaaagctgttttgactgatggttgattttctgctggtaattttgccattaaaccatttaaaactgtttgataattatcaatcgttaattcaatagacattcctgtagtagccaattgattattaatttgtgtttgtgttgttgttaataaagtattaaatacttgttttgctcctgcaactaaagttgcactttttccatctaaagtgactaaaccattatataatgtttcaatacctgttgttaatttttgtgatcctacaagagcagaagctgcacctgtttttaaagatcctacaccttgatcaaattcactgtatttagaagcatattgttttaagcctgattgtaatgtttgcccaccagcaataatttgatcaaatgatgaatttaatgtatctacactatcataaacatcatttaaatcatcaaaattaatatctgtttcagataataatgatggtgttgctactgacattaaactatttaatttaaatttagttgtatcatatttaatagttacagaatttaatttttctaattcttcattattatcataattctttgataatcctggagcagcaattgccataatgatattagaagaaccattactaattactttaccatttgtaacttcaatattagaatctgtttttgttggtaacattgttcctgttgtaacaacaaaaggaacataaagttctttaccatcaacagtttgtttttcattatttgtataatcaatttgaatttctactttcccctttttaccaagcatatcttttaacttcgttttcttaccatccaatttataagttactttcattgaaacaggtaatgaatttgttgttttaccttggtaataaatatcttgtccatctgttgtttgccataccaaactagaaccatcttgtttaaatgtttctttaccattaacatttttaatattttttaatgatgattgatcatctaatgatgtttcattttgatcattgataagatgttcagaaacaactgttgttttttctgaaccatttgtttttaacttactataaactgtttcttcttttgaataggcaaaggcaggaacaattgagctcatgaccgttgtcattacaactgctgaagaagtgattaattttgcttttttcatgttaacattctcctttattttttaattgtttaaaaccgatagaagtatgaataattactttatcaaatacaagtaaaattgctggtataacacaaataacaataaacattgaaataagtgctcctctagacattaaattacataatgatccaatcatattcaatttagaaatcattcctactccaaatgttgctgcaaagaatgacattccagaaacaaagattgaacctgcagaattactaattgcattatccattgctttaatcttatcaataccattttttctattttccaaatatttcgttgtaagtaaaatagcataatcaattgttgctccaagttgaattgttccaataacaatagaggcaacaaatggtaaaacatcacctgtgtaataactgattgccatattgataaagatagcaagttcaattccagaaactaacaatactggaagtgaaactgattttaaaacaaataacataatgataaaaataattcctatagatgcaatacttacatttctaaagtcttcatctgctatattaaccaaatccttcatgcatggaccttcccctgccattatagcatttttatcatattttttgataatatgatctatcttatcaatgactttatttaatttattggttgcaatttcttctgttgaattgacaaatatcattttataacgattactttcaaagatatctttaacatcatcaggtatcatttcatcaggaatagctaagtcagataactgtgatggtgataaaacaagattaacagattcaacattttctatttcatcaaccatttgatttaaatcattatctttaatacctttatctactaaaataacttgcgaagcaactaaatcaaattcatcacttaattcactattagccacacaactctttaaatcctgtggtaaatcttttgttagattgtaataacttttaacatgtgcatttccataataagctggataagcaataactaatgcgactaataaaataattttataatgtttaataacaaaatttttaattacattaaatgatggaataattggtttatgttttgtcttaaagacaagtttatcaaatactaataaaaatgctgggaaaattgtaactgttgaaaggaccccaataaagacacctttagccataacaattccaatatctgaacctaatgtaagttgcattgtacataaagctaaaaatcctgcaatcgttgtaagtgaacttccagcaatagaaacaagtgtatctccaatagcaagtgtcatcgcttcattatttgttttaactcttgtttttgcttgttcatatttatgatataagaaaattgaaaagtctgttgtaactcctaattgtaaaacagcggcaattgcctttgtaatatatgaaatttgacctaagaaaatattagatcccatattataaagaattgctagtccgatgtttcctaataatagaaatggaacaacataactatccaatgaagccattaaaacaattaaaactaaaataacagcgacaataacataagtaataatttcactatcagcaacaatacttgtatctaatgtagatgctgacattcctcctattttaacgacctcttcacttgtaatttctctcatttgagtaattgcatcgatcgcaattgtactatctttaaatgttaccaacatgagttcgctgtttccttttttatactgctttgtcacatcacttggcaacatttcttgaggtattgttgttcctattaaatcatttgcggaaataactttaacaacaccatctatttttttatacttctcttctaagtttaagacatctttagaagacatattttctacaacacacatcgcaaaagatcccatatcaaaatctttagctagtatatcttgtcctttcattgtatcaatgtcttctggtaaataaacaagaatatcataattaatatcagtattgatatatccaaataaagatggaatacaaagaataactgatgcaatcacgataagtatcttgtgtttaacaacaaatttaccaatgatttctcctagctttttcatagttctcctcctaaatgacctttggtcataaatgatactagcactaaaatgaccatcggtcaatatataaatgactaaaagtcacttttttaattaattcattgacatttttaattcttcaccctaaaataaatgctaaagggagtgtttttatggcaattaaagagataaaatcaaaaataaatgataataaacaagaaaaagaacgtaaactgcttaatactgcacttcatttattttcagaaaaaggaattaaaaaaacttctattcaagatattgttaaagatgcaggtattgctaaaggaactttttatttatattttaaagataaatacgaacttcaagatgttttattagctaaaacatctcatgaattattttccaaagcatgtaaggaagctactcaacaacaatttgatcgtttagatgataagattgtttttattatagattctattattaatgaattaattgttagacctaacattcttaagtttattcaaaagaacttatctttaggactatatagtgaaaaattaactgatttattagatagtgaagaattaggaatcaaggaattatttgtaaatgaagtaaaagaaaaggatattcctttagaatatcctgagatgactttatttatgattattgaacttgtaagttctacagtttttacttctattgttgaaagtcatccacttccaatagaagaatttaaacctcatttatataaaacaatacgcttattgattaatgaataaaaggatgtcgtgacatccttttataacgtatctaaaaattgttcataatctttaagaattttttctaattcttcatacgtatttacttttgaaagttcatttttaacagcagacgaactttttaaacctttgatataccaaggagcatgtcctctcatttgtgacatagcaattctttcaggttcaatcgtcatcaaccttttagcatgtgttaaacaccatgctattttttctttataagttggttcaggtatatctgttccatgttctaaactttctacaacttgtttaataagccaaggatttccaagtgctgcacgaccaatcataattgcatcacagcctgtttcttcaagcattcttctagcatcttctacacttctaatatcaccatttccaataacaggaatactaactgcttctttaaccgctttaataattgaccaatcagcatgaccttcatacatttgtgaacgtgttctaccatgaacagcaatggcactagctcctgctttttcaattaatttcgctacttctaccgcattaatatgttcttgatcaaaaccacttctaattttaactgtaacaggtttacttacatttttaacaatattactgacaatatcataaattaattgaggattttgaagaagtttacttccagcatttgcttttaaaaccttattcactggacatccacaattaatatcaataatatcacaattagaatgttcatcaataaacttggcagcttgtaccatactttccacttctccaccaaacaattgaatactaacaggatgctctccttcatctacttgtaacatttcaattgttttttggtttccataacaaattgctttatcactgaccatttcagaataaacaagacctgccccaaattctttcacaattttacggaaagccatattagtaataccagccattggtgccataatgacaggatttttaatttctatatctctaattttcaaattttatctcctcctgtatataatttaaacatctgttcataatataaatagataacttatatattccctctattttcctcccctaaatagatataagttatctaaataagagttgatttccttgaaaataaaggcatttgcctttatttttctttacaagttaaccctgctgatttttggttttctattgtatcttttaaagatatataatcaatatctttataactaccatttgtacttacaagtcctgcttctactaaatccttcatataatcttgactatattgaatatctacttcataaataatcttatttccttcaacctttaaagaagttttaacaccttttacgttcttataaaatgtattactattttttatataatctttataataagaaattggataactttctgatacataatctgtataatcataaattactttcgtttttgtttctttaactttatcatcactagatataacttctacttcttcatctgtaatcatatctaatgttcctttacaaattgttgttttagtaagatgacctgttaaatagaaaacaattgcacctactaagataataagtataattcctattactaaagctattaatttctttttcttgttttccattttttctcctttaaaaaaatcacatttttcaatgtgattataaacgatttattaaattttgcaattcttcttcactaaattgatattttgtattacagaattgacatgtaatttcacaaccatgatcctcatcaatcatactttgaagttcttgttttccaatagttgataaagcattgatcatcttttctcttgaacaatcacaagtaaagaataaatcttgtcgatctgtaatttcaacatcatcaaaaatcatttttaagatttcttctggtgtttttccttcatgaatcaatgaagaaacagcagggaaatcttttattttttcttcaatataagaaatatcttcttcagtagcttctggtaataattgaataataaaaccacctgaagataagatttcatttgtttcatcaactaaaacacctacagaaacaactgacggagtttgttcacttgccatgaaataataagaaaaatcatcaccaatttcacctgtttgaagtggtactgttccacagaagggttcttttaaccccatatctctaatcacttgtaacgttccttgtgttccaacagccacacctactgctaaatgtccagtatcattataagtataatgaacatgtggatcacctacaaaacctttaatatgtccatcaccacgcgtaacagccatcatcgtaccaattggtcctccaccattaattgtgacagtcattttttcattatttttattcattgcagccatcataagagtagctgacatcattcttccaagagcagcagatgctgttggccataaatcatgttcttgtcttgctttttctaataaattcgttgtttggcaggcaaacacacgacaatttttactattgactaatcctcttactaaataatctttcatttttcttttctataaaaagaacacggaagaaaatatcggaataatcatgcttaaagcgattaagatgattacaattctctttgttcgtgtactcatatttatcccctttctaaatgaaaaaaagcgaaattcgctttatttcatttcatctaataaatcatcttgatcatcaattgatggtttttcttctttaacttcttgaacaggttcttcagttaaagttccatcatgatgttctaacattttacctgtattgtataaagattcaatatcttcaccagataatgtttcatgttcaagtaatgcttctgcaatacaaataagtttttctttattttgttcaataatatttgttgcttcttgataacaagcatcaataatttttcgtacttgaacatcaatttcataagcaatttgtcctgaatgtgtattacttctttgtgtataatctctacctaagaaaacttgtccattttcagaatcatattgaataggtccaagttcagacatacctaattcagtaaccatcattctcgcaattcgagttgcttgttcaatatcgttgtgtgctcctgaacttacatctccaaagaagacttcttcagccacacgtccacccatatatcctgaaatagttgcttttaattgactcttagtttggaaatatgtttcttctttaggtgtcattaagttataaccacctgcttgtccacgaggaacaattgtaactttttgtactttattggcatcttctaaagttaaacctattaaagcatgtcctgcttcatggtaagccactaagcgtctttctctttctgtatatttacgtgatttcttagcaggtccacccataacacggtccaccgcttcatcaatatcagccattgtaattaaatcatgattttgtcttacagcaagtaaggcagcttcatttaaaacgtttgaaagttcagccccagagaaccctggtgtacgttgagcgatgttatcaaaattaacatctggtgcaaaacgtttatttcttgcatgaacttttaagatttgactacgtgcacgtttatctggattagctacttggatttgtctatcgaaacgacctggtctaagtaaagctggatctaagacatctgcacggtttgtagctgctaaaacgataattccttcatttccagagaaaccatccatttcaactaataattggttaagtgtttgttcacgttcatcgtgtcctccacccataccagtacctctttgacgaccaactgcatcaatttcgtcaatgaagataatacatggtgctgtttgttttgcttttttgaacatgtcccttacacgtccagccccaacaccaacgaacatttctacgaattcagaacctgaaattgagtagaatggaacgtttgcttcacctgctactgctctagcaagtaatgttttccctgtacctggtggacctacaagtaaaacaccacgtgggatcttagcacccatatcagcaaatttctttggtgtttttaagaagtcaactaactctttaacttcttctttttcttcatccattccagcaacatcactaaaatgtgttttagaatttttttctagtttagctcttgaattaccaaattcaaaggctttattattaccaccagcagtatttgacatcatcttcaagaagaagaacattcctccaaataagatcaagtatggtaataagcttacaatgaagttcaataattgatttctttcagcatcattgacaacattgatttttgtaccattttcatctaacaagctaattaaagaatctaattctgtttctgttcttggaataacaacagagaatttagtatcttcttttttaccattgcttgcttttttagaatatgttccactcacatcaatgactaatgatttaggaacgatttctacatcttttactttttctttttgaactatctctataaacttatcatatctaatttctgacgattcactttgattaaagaaaggaattgccacagaaataaccatcagtacaataagccatggtaggatagacttcaacaatccttttttatttcccataaaatctcctaactattttttataacaatcttcttttaaaatacctatataaggtaattgacgataacgttcattaaaatcaagaccatatcctacaacaaaggcattaggaattttaaatcctgaataatcagctttcatatcaaaaacacgaccttcttctttatctaataaagtcacgattttaacactcttagcatgtcttttttctaacatttctttaacgttatataaagtctttccagtatctaaaatatcttctacaattaaaacattcttaccacgaatatcttctttaatatcttgtctaacaactaatgttttagattcaacaccactataactacttactgacataaagtcgaacttaacatcactttttaaatgtttagcaagttctgccataaatggaactgaaccttttaataaaccaactaataaaatttcttgaccagcataatcttgatcaatttgttttgctaattcatcacatttagccttaatttcttcttctgtatataatatttcttttatatccttgtgcataccttacacctcacttacatgtgtcatattttatcacaaaaacatttggttttgtatataaatacttgatatttttggcgatatgtgggatcaaaatgatctcaccatggcaattttcaacgattggccatattttacgctcatctctaggaattttacgatctataaatagcctagagaccttttttgttcctccagatgttttgattgtatcaccatttttaaaacatcttataactattggaaagtcttcttttgaaagaaaaacaccatcgtgaagatgtccttgatctgttaaaaaataatgtaattgttgatctttataaaaagattcatactttacataataagtatcgtcaatttctttttttctaacggctatattattatacttttttatgaacacaaaattaacaggtaatgatatttcaatatttggtttttgtgaatggatttgtttaataatttcttgtactaagttttctgttataagtggtggatagatctctttttttaacatataataaatgatttgatctaatgattctgttggtaacttatctaaatacaagaaatgattttgatcatattcttgataaatttgttggagttttgcttgttgttttttgtattgttgattatgcttacttgccttttctaataattcttgttcattatattttttaagatcgatatgtcttacatgattacgtgtataacgtgtatcatagtttgtatagtcttcatgatattcaagatgatttttagtacaataatctataagttgttgtttttttaactttaataagggtcttacaacatgcatatttttaacataagattgttcttttatacccaaatatccctttgtattatatctttgtaattgcatcacgattgtttctaaatgatcatttaaatgatgccctaaaataatcgtatcaatcccatttaaatcacctatttctttataaaaagcatatcttttttctcttgctaacatttcaaaattacctttttgatattcttttttatctccttgtcttacataaaaaggaagatgatgattttgacaataactacgtacgagattttcatcaagatcactatcttctctaaaatgataattataatgtacaacaatgacattgtatgcttttttaactaacatatctaataaagccatcgaatcgacgccacctgatactcctacaagatattttctatttttatctaataaactttcatctaacataatctcaccgcttgtattatagcatatctctaatttctattgaccactttaataacaataatactcatatcatctagatctttcttttgaaaagatttttgaaaaagaaaggaaacaatttcataaactgacatcttttcaatttcttcttgatatttttttaataaatcaaagaaatgttctcctactccatcacttgtaagaatcaatatatcattttctttgattttcatatcataagaaaccatcttcattgtagaagccattcctactggtaaagaatgtgaatgtaaaacatctatttgatgatttcttattaaataactttcataagctccatatttaattacttttaatcttgaattcattaaattaaaatcaaataaatctaatgtcgtatacatatctccctgattctttatctttaataacgtatttaaagtattcaatgtatctcttaattgaatgccatttttaagcaattgacttaaaacatccaatgttaacttactttccttataagcaatataaccttgtcccataccatcagataaagccacataatgatgttcatctaaaccaaaagtaagaatactatctccacattgttgatctaaagcatactgttttttcgcaagttgtaatgtatatttaagttcatgttttaataaaattgaagtgtaacctatttgaagatgttgctttttaatagagacaagatctaatgattcatttaaataattttctaaaataggaataagttcttctgttacagtttttttatctatatcttctattcctatttctaacatataattttcataatctttttttattttctttaaataatacacttcaaaatgatacgcttttaaatgctctaagattttcttttcattatcttgttcatctatctttttagaaaagttttgaaaaacatgccccatgattgaaaactcttgaaataaatctttttttaaatgatcatgtgcatgattaacttttaacatcttaaaataacctttttgatgattctttaaactctttaaataatcatccggctttaaacaatgttgataaatataattataatcatctacctctaaatctttttgaattcccttagaaatcaacttacctaaacgactcattccttcttgactataaaaacaatattttttagaagaacaatgatgacacacatcctcataaacatatcccacatattcagataaatgggtttcttgattttcttctttaaaaacttctgtgagttgatgaaataaagatgcaaaagcatctgctttacttttaagttgttcttgataacttatttctataaattctggattgatctttatttttttatttttaaattgtggagaaatcataaataaaaaaactggaacaagaatcacaaaagcataatagaagtaattgtaattaataaaaaatggtagtgtaatatgtgataataagaaaatagatatgaatagatatttgtttttaggttgcatcataaaaaagaaactcattggtaatattaaggataagacatcatcttttaatgatggagctatcagcattaaaagaatagaaagatataaaataataggcatgactttttcaattgatagataataaatagaaatcaataagaaatatcttaaaaaaatcattgtatatgttgtattaaaaggaataaagctaataaataatgtacataccacaacaattaatgcttgtaatctttttatatttaaaacatttttattttgatgaataattaaaggaataatttcttgatcaagataacaattaaacaacgttaacatgacaagaactgttgtttgtaagatgttgtaatgattcgcataaaaaaatggaatcaaaattgctgttataataaaagaaatatactttgtttttaatagatgtgtaaagttaagaagataaatggtcagtaataatgtaatgatgacaacaattgtaaatgtatcttgattaataatcgatattcctataatcgctgttaaaaagcatgtgagatacagatatccactataaaacgatacaataaataaaggtaataaaaaaggtaaggctgtttcttgtattttagcatagcttaaaataatggtactaaaaaatataatgattggtaaaatataatgcacgtgtttttgtttattgacgataactaaatccattttatttccacctcgtaatcattatatagagtttattttaaatattttgtcactaaaaaaagacatctttaaattggtgccttttattttgaattatccatttaactcattttgataaaaatatgagtaactctatttatttaacattttacgataaagtacatcttggtaaaaccaagatttatggattttatcgaatccatttctttctaatagtttaattgattttatattatcttcatatacatgacataaacatattttaaaagaatatgtttcatgcattgccttaaatacactctttaatgcttcacttgcatatcctttagaccagtaaacactatctaaagtatatcctaaagtaaaagttgtatgcccatctatttcaataaaaatatctccaataagttgattgttttcttttaaataaagaccaaattggtagttaccaatttgtccatgaaatggatgcttttgacaatattcaatacggttaatagccttatttaaaggatattcatcccatgattgatacattgcaacttcttctttatcacgatattcactaaaacgtttggcatcatctaatgtaagtggcttgattatgagtctttctgtttctatattcatattattttaaattataatagataaataacattctatcttttccattaatgtctttaataatttcaaaagggtaatctccaaagaattctttgattgctgtttccatcaattctctttgatcaaatcccatttcaaaagctaataaagctcgatcatttaataaaggttttacttctttaaaaatcttacgatagaaataaagaccatcatttcctccaaataatgctacatgaggttcattgtctttaaccattgcttcaatatcttgatcattaggaatataaggtggattagaaacaaagatatctactttttcatgtgtatctaataaaggttgtaacatatctccatttctaaattcaacattcgcccctaatgttttcgcattatcttgagcaacaactaaagcttctttagaaatatctgtcgcaatgacttttaaacgtggttcttctaaagcaagagtaatcgcaatagcaccacttcctgttcctacatcacataaatgaatttctttataatcattaaagtaatcatcaatacgatataagatgttttctaccaattcttctgtttcataacgaggaatcaatacatcttcattcactttaaagtctctaccaaagaaactttcacaacctttaatatattgaataggtttcccttgataatattcttccattcctgcaagaaaagctttttctaattcaggttctacttcttcattcatcattaaataaagttcatgaggttcttttttagcaagatgataaaataagacttttgcgacattgacatctttatgttcatcatccaatttactttcggcttctttaattaattctctaactgttttcattatttttgtccttctaatttaagacgttgatcttcattgattaatgctgtaataatatcatctaatttaccttcaataatacgatctaattgttgaattgtaagtccaatacgatgatctgttacacggttttgaggatagttataagttctgatcttttcagcacgatctccagtaccaactttcgattttctttcactatcaattgcttctgtttgttgagattggaagtaatcataaacacgtgctactaaagctttcattgctttatcacggttatcatgttgagaacgtccatcttggcttgttgccacaattcctgttggtaagtgagtaatacgaacagctgaatctgttttattgatatgttgtcctccggcaccacttgcacgataagtatcaattcttaaatcacttttattaatttgtacatcaacttcttccatttctggcataactaatactgttgcagttgaagtatgcacacgtccttgtgtttcagtcttaggaacacgttgaacacggtgtgatccagattcatattttaatttaccataaacaccatcaccaatcacattgaatgaaataagtgagaaaccaccagcttcagattcttcagcttccataacttctactttccatccttggctttcagcatattttacatacattctatataaatcacctgcaaagatatttccttcatctccaccagcagctccacggatttccatgataacgtttttattatcatttggatctttaggaattaattctaattctaattttttaataatatctggcattctttcttctaattcatctaattccatttttgccatttctttaatttcaggatcattttccttcattaattctttagcaccatcaataccatcttttacttctttatattcttgaaacaaatcataagcagcttgtaaagaagcttgttcttttgtaacatctgtcatttttttaatatctgtaccaatatctggatccattaacatatgacctaattcttcatatctattttccatagatactaatctatctaacatactttcattcatagctttttacctccattaaattttttatactcatagcacaataataatacatgaaatagacgatttaaacaagaaaaaatgggcattaatgcccatttggaacttgatctaataattctttttctttgactaaatcagcatataataagtccccttgtaaaataattaagaaaataagtgaaccccatatagctctatctttaaaataatgacacatcacagtagaaagagcagcgccacctataaaacataaaatcatacataaatgtcttaaagaacgatttaaatatttcttttcgtgtctctttcttaaccaacgaacaaagaaacttcctgtttgtctaatatgatttgtgacaaaagtagtagccatcccaaccttttctgcttgtctaaaagtattaaattgcattgcacaaataaagttaattgttacttgaaatacttgatcaggtacactactaggaagtagtcctaaaataataacagtaattatttctacccctattaagatggtatcccatcttaattttctatatttctttatttttaaagccaaatattcagaaaccattgttcctataaaataagaactaataggaattaataaataagcagctcttgagaaatccatattgcctaaagccatgccaaataaaacaatattggctgtttgggcattacagaaaacaccaccttttactgaaaaagtataagccccaaagaatccccctacagtaatcaataataaaaaacaacgccaacgttcacactctagaaagccttcttctttttgttcgagttcttcttcaacttcttctaactcatcttctaattgttctacattctgttctacttcgtcataattttccatttttatcaccgcaaatattatattcctgtaataatttgttatcaagatataattctattaaaaaagacacatgttttcatgcgccttaagtaagcgtcaaataaataagcgattataaataatggatgaattcaatacaataaggatgtacttaataaggaggcgcatcttttttgatactttatgtcctgttgatggtattacttcttgttttttgataacttctttacatacagaacaatgttttccttctgttaatccatcttctgtacatgttgcttttttaccttgatcaacaactactttatgccctgttgcttttttgtcatctactatttttgtttgtgacttaaatgcattatttttgaaattagctatataagtaattattccattttctgtacatgttggatctttaacaattttttgagctgtaacagtttcttcttctatatgtaaaccattatttaaacaaattctttttgctgttactgtttggttatcactagaccacgtataaataggttgatcataattgtgtccaaattcactacattcgtcgtagtcataatgataagttggtgtgatttcactaaaagtatttccttttggaagttgttcccattgttcttttgagcccgcataatatatatctgttatactatgtacatttgcaaatacataatcttctatttcaattaatgattttggaaaataaaccttttttaaattttcacatccccaaaaagaagaatcttctatcctttttattccttcaggtatataaacttgttctagattaatacaatccataaaactactataacttatttcttctaatttattagataatgtaattttttctaagttttcagctcgattaaatgcataagaagcaattttcgttatgtaattaggcattatataactcttttgtttatttccaccttcatacattaataaacaattatcatgtattaatgcaccatctactattttataatatgtattcccttcttctactgttattttttgaattggttctgactgccaataattagtgaaacgatctccacaaattcctactcctccaacttctttaggaatgaaaagtgattttaaacttgtttgatgaaatgcatattgtcctataagttcgatagaacgaggtatatttgttttttctaaataattacaattatcaaatgcccaataaccaatataggttacaccatctggaatttgaatagatgttaatgtatcattataagcaaacgcctcatcattaatatatgtaacagtatttggaagaatcaaatcaccaaagttatgtttagttgcactagaaattactacacttttattttttgtatataaaatttcatcatctacacataaatatggattattgggggccactgtaatttcttctaactgtggacaataatcaaccaaaccattgcatccagaaaatacgtttccttcataatttcccatattcaaagttgatggtaaattgatttgtttcaaattaggacatgatcctacaagtattccttctaaaaattcaattccttctgaaacagttattgtttttaaattttgattacttataaatgtataatgcccaatacctacaactggtttgttatctattattgtaggagtaacaacattttcatcagatcctgtatatttagtaataataacttgatttttatcattgatttcgtattcatagtcaagatattgattttctgcttctgtataagatttatcccacattggatattcttcaataaagtcatttgattgatagtcattatcccttacatgatcatcaaaatcatttgtattttttaagaaataagcatatgtacttcttcctgcatcccatgtactatcaagattataatatttaccatttaatttaacgatattccaagcatgtggtccccctgcttcacctgaaataactcttgtatctacacctgcatctaatgctaagcgataaaataacgatgcatatccttggcatactgctgttttattgatcaaagctgcataagctgtatattttaatgaataggattcatcatttaagttatcatgatcatatgtaacatttgaacatatataatcatagattgcttttactttttgatagtctgtcttatttgataaatctaatgacttcaataaattagagacttcttcatctactttttcttcctgttctaaactagataaataagatacatcataaaaaatatttaaatcatatccctcattagaatttccagatgtgtttacttttactgtccacccttgacagtgctatttaagatagtctccttcttttccattaccagtatgtttgatggccttttggaacaactgatgtactaaattagaaaaaaattcttgtgtaatttcctcatcgcaatgataataaagaacaatattactttctctattaattaatttttctctaaatatctttacaagtttttcttgatcacttgtatattcaacatcttctaaactatatgtttgaatatcatgatgaacaacactactttttacatctttataaataggatttacataatgatcttctctaattgtttcttttgcttgtacattgactatacttaacatagaaaaacacattgaaagaacaagtgatacaataaataatttctttttcatgatttccctccttatattcatttaaccatgtaagccatttcttttcaagaatatataaaaaaaacgaggatactctaagtatcctcatcaaattcacattaatatactactacttttgttcctgaaggaatattatcataaatccatttagcatattgtatttcaagtcttacacaaccatgtgataatggaattcctgttctattatcttgaattgtaccatttttattataaagagtactatggaataaatagtttcctttaaattgtgtataccagaaacatctagatgatcctgagtcaaaataatatcctcttattccaactgtaaattcacctttaactgtaggtgttgaagctttacctggggcacaactataataatgaatattgttccaattatttacagaaccttgataaatagctactcgacaattagctgtatcaactaaaatcaaataattagtagcactactgtatccgcttgctctacttgtcattgaatcataaacactatcgcttcttaaagccccactagaagtaaaataaaatgcttcaaaatacgtatcatgtaacattgctccatatgaatttaaataataccattgattattatcttttaaccatccaatagccatatttccacctgaatgtaaataataccaagttccagcaatttgcttccaacctgtgcacattgccccacttgcatccatataataccaagttcctttaacatttatccagcctgttaacatactaccatacgcatttaggtaataccattgaccattcaaatcaagccaacccgtgtacatatacccttgacctgattcatctaaataataccatttaccagaaactctttgccatccagtttgcataacaccatcgttatttaataaataccattgatttttaacataaacccaacctgtgcatttatttccattttgatcatagtaataccaatcattaccatctaacatccagcctgttttaatagcaccattttcatcaaaagtatatttaacaccattgatttctcttacttgattagtaatagcagcatatggatatgtttcattattagcatctaaataataccatttaccatagtatttataccatccacttactaaacttgcatttccatcatagaaataccaatgatcatcatcatttatccaccctgttttaatagcaccattttcatcaaaatgatatttgattccattaatttcttttgcttgatttgttactgctgatgatggatatgtttcatcattagcatctaaataataccatttaccataatatttataccatccttgtttacaggtagcatcattatttacaaaataccagtgattttgatcatttacccatcctgttttaacatttccatctgcatttacatagtaaaaagttccattatcattaacaatacctgtaattgctacatcattttcataaaaataaactttcccgttttctttataaagtccattttttacttcaacaacatcattcatctttacttcatcatttccctctaatgccgaaacaaatgatagactcattgaaattgaaaagagaaaaatgaaacatgctattcctttcttcaaataacctttcattgctcaaacctcccttgtattcattttatcatcaaaaaaaactctaaacaatataactaataaataaaagctagaaataatttgatattctcaaattacttctagcttcattaaactaaacaattaataatattacaaaaagcaaaaactccaaatatagccataaaataatctaaattttttattctatgatgatatctagaaattaataaacagcttgctataatcattgaaaaatagaaaaatagagcggttctatttccggaaacccaaacagttggcgaaaagcaaagcataaatcttgatccaaagccaattaataagataataaaaatatctatattttttctattatctttaattaaaaataatatgatgattaataatgtaataaattctattaaaaacataatatatggaacaaatgattttaaattacttaaacttaaaataccgtattttcctaatatagaatatagaaaagaaatatttggatataagtctactaaatattttcctaaaacgccaaaaactaatgtcattacaaaaataatcattgtacttgctttcactaaactatttttaaaagtattaataattattaaaagtgttgatgataaaaataacattggtacattatttttaaataaaataggataaacagtggaagaaattcctatttcaatttttctaaaaaaggataatgttccaaaatctgggaaccaatttttaacttcttgtttctttctcacccaattcccaggacatgtaaagatatatgttcctgatgcaatgattaaaacaatatttaaaattacaaaaaaactaattttccttttattgataaagcagtaaattatatagaagaaataagttcctaacaaaattgcaaaaccttgttcttgatttgcggcaaataataaggctatagaactaataatatattcataccatttcaatttaataaaattatttgctttttttaaataatataaatttattaaaatagcgcctaatggccaataataattaattgttgtggccatccaaccagcagaagacatatcaatcaagggatagataagtgttccaatacaacaaagtattttcatttttattgtatgattacaaaatattgcttctattaatttagctataattgtaataactaatgagtttaaaagcatccaaacatgactatgaactgaaataaaataaagtacactttctatcaattgcctagaagaccaattatagtatttatatatattaaaatctgtaaaagtcattgattttgctcgaattgcaaaatttacatcatcacctgtacttacattcaattgaatatgtataaataataaaataaagaataatacataatatggtatattagatataaattgtttttttaatttactcataattttccccatttaccccttaataattcctgctttatttaaacaaagcattataacaacatctatatacaatagttgaactaaaaaagaattatatttttttgtaattttgtctattctatagtttaaagctctttttgtcatatgtgataaatgtatatctttttgagataaaacatctttaaataaagttacataatcttgatctaataaaggatttctattacttgctgtagaaatacctcctaattcatattgaattgttgggtaatcaatatatccaattttttcgttattaaatgcaaggttagcatagaatggataatcttctaataacttatatttttcatcaaacaatccatatttatcaaaaatttcttttttataataagtagaagcccccgatacaaaattaccgtatttcataatatattcaaaaaaatgatttgattgatctaataaagaaacctgatataaacttggataatattctatactattttcttttttgataattctttttgaagtatatataagtttatcttcttgatcaaaagcattcataatttcttgtagagaattttcattataaaattgatctccacttgataaaggacaaatgattgttccttttgcctggctaatcaaactattaaaatgtttgacagttcctctattaattccattatttataagtttaaagtacgtaaattcatttttatactgttcagtgattttatcaaagtcttcttgcgtataattaggtgaaccatcatcacttacaataacttcataatttgaatatgtttgcttttttattgaatctaatgtttggattacttgatttaaatttttataaaccattacaataattgttgcttctatattcatgtatttttcctttcttaattatcttttaaaactttaattatattttgagttacatattttacatatttatcttcaaataattcatcttttaattttaatcttttttcttttaatggatctattccattttgtaagtctaaaagaattttttctacatcttcaaaactataagcattataagatacactaaatatttttttcataatatcattatcatccacagcatcagtatgacaataaataataggtttacccgttaaaaaataacaaggtataattgatgaaatatctcctacaaaaacatctgaatgccaaaatgttgtaaaatactctgatgtttgatcataatataactgttcattgttttggaacttccttaaatattcatctacttcatcggatgtaatcaaacctaaagatataaaatttttaaatgtaagtggatgaggtctaaaaacaagacttcttttcttatctttttcaacataatcaactatgttatctttataagttaaaaaattacttcctcccaattgcgtatctattgtccatctaggagcccatataatcttgaaacgttgatcatcattatcccaaaatagattatcttcactttgtgctttattaaaagcattaaatataggatgtcctgttaatatcgtttttcttaatcctaatcgatgagataaaggtgctctttttttattaaaagattctgtaacataactatccgcaaaaaagatatgcaaatatctaaagaaatccacattaagtgaagtatcaaaaatatagttcatcatttcatatccataaggtaaataacatgtttttgcatattttgaaactgtagatattttatattctattggtaagtaagaactataaggtctttcataaaaaacatagtctgggttaatattttttaaatcaaaccattttccttgatcaaaagctttaattgtattttgatgattatgatttttatgaaaatcataaatctttgtattcattgtttggatatcaaattctttttttgaataatcaaactctggaatcattaaaacatatgtctcaaactgatcatcattagataattgattatataaatcatctacattgatccacaaattagacatttgtgaaataaatactatcttttttttagtgtttgttactttttttaaattttttattttaaaatcggctactaaaaagcggtatgaatcatatatttttctagcaactttatacgttaactttgtcttattcatattcatcttatccttttattaatttaaaatattctattattttatttctatttaataaagcaataattcctattatacctacaaatataattcttaaccaaattgtataatatgtaaatgtcaataaaataattaaaactgtaaaagcagtcgcaataataaatatttttttccaatcaaacaatgtatcatatctataatcttctattttatctttacatgatttattcatataatatagattactcaaccaaaaaacaatataggaaaataaagttgtatatccggctacaacgtatccaaaaacaggaataagtataaaatttaaaacaatatttaaaacagcacttaatatagatcctttaacaagataactattttcttcaaaatagaacattacatttatacataattgtgataaaaataagaataataaacttcctgctactggaggaacgacccaaatagcatctttatatttacttccccctaagatagcaatagcttcagggccaaataaaataagtacaatcaacattgtagcaataaatattataataatatttgttactttttttatcatattatgttttttatctttaatacttctgtatgtccaaggaacaaatgaactattgatagagttaataacaaaaactaagacaaccgcgaattgataagcaacactatataatgctgcatttgtttggccagacattctactaatcattattcgatcagattgattaaatatcatttgtgataaataatatggtataagaggtatattaaattttaaagcatatgtccaatattttttatcatataaagccttccctttatatgattgataaatgtatataattaaaccaatacatagatatactgcagtatttcctaaaatacgtgctattcccttttcttcaaataaaagtacaccaaccaaccctattaaaggagatgtgactgatatgataagagttacaataatcattggtttatatttatacataaaacgttgtttatttgtccaaaaagctaagactgtactcatcaatatttcaacaatcattgcaagaacaagtattgatggtaattccaataaatcattccaaaatactggagctatgatgtatataattaaagttattaatgttaaaactgaaacaatcccttggatagaagatatgtatctatctcgatcattttcaaatttaatcatagctgtatcaaatgacccatattgtaagttcaaagtagcaaaaatagctacgatattcatccatgattgatagatactatattgcccatattgctgagttgtcattaatcttgtaaaaataggtaacgttattaaaacaatacacttttgtacaatactacaaattgtataataaatagaagctttcacttcaacaggaacatttttatatttcgatattattgatttaaccatttaaactctccttttttcaaagcaattatatataaagaaagcagtgaaagcaaataatcccttatttttatttcactgcttgtgtatttttatgctattttctttaataagctaacaaaaaatcttcttcaatacctgcacaaatcaatatgagtaatatatttttataatatctatacttatttttcaattacacaatcatcataaacatacaatataatatttgaacaatcttgattttttaataatttcaatactttattatatattttcttcttttagatatgcatagacattatgaatcaactttttcatacatatcatactcctattttttacatatagcataccattctaaatcttgatatctatcatcaataaataaatgatctttaaattttccttcataaataaatccgcattttttataaaaagaaattgctcttttattagatgataatacatttaaataaattctatgcaattgtaacttatcaaaaccatattttaataatgattccgttgctttttgattggcacctgttcctcttgctttttttcttgtgctaattgcatattcagcatttttattttttaaatcaatattttttagagaaattgtacctaaatattcatcatcttgatcatcaacaattgcaaaatgttgttgatcttctctaaaagaattttctacaaatttttttgctgcaacatcatctatttcagcaaaattattttgaaaaatatgttttgcttcttcatcatgcatccattctagcattaatggaacatcttttaattgaagttttcttaatgtaatcataattatcctctcattatttaaacgcatttagtttatcaataacataattcacttcttcatctgtcattccatagtacattggaatacttaaaacagttttactaatttcttctgcaattggtaaacttccttctttgatatttaaatctttatatgcttcttgtaaatgcattggtataggatagtgttttacagtcccaatcccgttttcatttaaatatttttctaattcatctcttttatcacatctaataacaaatacatgataaatatgtctataatcttcactatcttttaatggtaatttaattaatggattttttattccttcaaaatatttatttgctacatttcttctatattcattccatttatctaaatgtggtaatttacaacgtaaaaatgctgattgaatttcatctaaacgactattagttcctttataaatatgatgatatttgtaatctgaaccataattacctaaagctctaactttatcagcaatttctttattgtttgtaacaactgctcctccatcacctaaagcgcctaggttcttacctggataaaaactaaaccctgctgcatctgacaaagtacctactttttgacctttatattctgttccatgtgcttgagctgcatcttcaataacatataaattgtgttttttagcaatttcattaactgcatccatatctgcaggtcttccttgtaagtgaacagctataattgcttttgtttgatctgttattttttcttctattaaatctggattaatattataagtctctaattctggttctacaaatataggttttgctccacaatatgaaacagctaaagctgttgcaatatatgtatttgatggaacgattacttcatctccattacctatattcatcgctcttaaaattaaatataatgcatctaatccagttgctacacctacacaatatttagcattacaataatctgcaaactctttttcaaataattcacattcttttccttggataaaataattactatcaattactttattatatgcttgatctaaatcttttcttatttcatcatgcattggtttaaatgttgcaaaaggtatcttcattctattcactctccttaataaattctaaaaaatcatcatagtttctaatataatcactttcatcatatgattctgaagccaatactagcaatactgcatcaggagaaaaatcaaacatttctctccacatattattagccacatacaatccttcatatggtttttctaatggtacaacttttttttccttaccattatctaataatattttacaagttccatgtatacagattaaaatttgttctaagtttttatgtgcatgatatcctctacggactccttctcctgtatcatacatatagtacactcgcttaattttaaaaggtatatctttaaattcttctagagcaacaagttgtcctctatcatcaccatgtggttgaaacatatattttattacttgcatttttacacctctttatccatttttcttatactattatatattaacattattatcacatcaaaatactcaatatttgaaaaaatactattaaatttattaattctataatcaatgagcctctattttttataacggattgtatgatctatttatttttgttctaattatttgaaacagtcccaaaaaataatctatttaaatttgatatacaatcatcacttataataattcataagatttgaacagttgattcaaaactaaacaaacaatattttcaagcaactcttcattcttaaaacacattacaataatactagcaaatatttcttcattttccaatatctgtttctttcatccttttaacttattttttgggcaatttttaccataaatgaaaataactttttgggtaaaagagctgtcacaatatcaaattttgcaatgtcaggtgcaagatatctcaatttaaataaggtttttatattacctgttcttctagcattagcaaatttctcaatttcatttaaatctttgtgattaggatatttttgtttaaaatcttcaatcatttttaaatcaggcattattctctgattgatataatcttcctttgtctctattccaactaatacaccactaacatttttcccatgtcttctatattgaactaaaggtaaatttaagtaccctacttttccttctgtagaagtacacgccaatacccatttatcatgacctgtgtattttgaaaatggtaaagacttttttgcaaagctagctttcattataatactcattcctactgcataagtaacaaagatattatatttagttatatcatcgtaagtattccaattatcatagtttttattactatgttttctaacgctactgcaagtgacgttgtcattttcatcaattatttgtttatccgtaacaactaagtcgatattcttttcattcatatatgcgacacacttttcaactttatcatccatccatatatcatcttgatcacaaaaagcaatatattcaccatctgatctttgcaccaatttttcaaaagcccccatgtaatttaaattttcttcacaatatggcaaaacctcataggaaaaatttgtgatatatttttcaaataaatctaaattacaccttttttttatacaatcatcaaatatatatagttttaaattaggatatgtttgattatttaaagaaattaattgttttatcaaatattcttcatttggattatataccgacaataatatatcaacttgtttattattcataatattttttcatcctttctttatacaacaaaatttaataaattacaaatagtgcaaataaatttgtaatttacatagattttatttcatttataacatctttttttgttaaataataaattgctattaatgcaaaagaagcaaaagaatattccttcacaatctttggaaatccaattggtaatagtacgacattattacctctaattcaataaatattaacacactttctttaacaattaaatattataaataaatattaacaaaattaaacactatggtatggtgatttttttatcattctttagcaatgtaccatatcacttaatgaatttattaagttagaagtcattgcaaatattaaaataacaaaaatatataccaaaaagtatttttaatcttcaataagataacaaattatttgtaagtttcgcatcttcagtataatgttcatctttataactagtaattcttaaaatattaccacctattctccatacatttttatctatcacaactacctttcaacatgataccatcttctacgacaactttatcacgactttatacaattaacaatcttgtttcttactttgactttgccattggcaatgtcgcaaagcataaactatattactcaaatgtcatcccaacaacaaaaaaaatctatatttgccttatcaaaaaatgacagacattatttgtattgcagggcttgaatggtgtgttttcaaaagagcaagaaatcggtataaatttaaataccacttgctcaaaaaaatacatatcctctgaaaaatcaatgtgcaaaatctagcggatgcgtttttttaagtaaaattatcacttatttctctatatgttttcgaacctacattctgtttaattattgactttaatcgtatttttacttatttttcgcataataggctttatcttttactgcttatagttcatcatataatttatttataattttatcatcaaaatcctcatcaaattttcttgccattaaataattaactttttctaattcgtcacaatcctctattgtaaaagttttagggtgattaatttgtcctttccaattaacatatgttaatttatcgtagtatttgtctttaaatctactattcatataaatcgtttgaaatatggattcatctggaaccaaagagcctttataatagtctatatattcaccttttaataatatatcatatatttctttagcacattcataggtcaatgtccaccattgacttccataatagaaatcaacgttaagtatattttttctatcaagtagagttcctaaatgtagtgcaatgtttatgtatcccatctttaaacatcttacaaaaaaatttttgcttctcatccaatttggaaaatacaattcatatcttttttttatagtattttccctttcaaatttatttatttctataaaatttttccctttatttttttctaaaaaatttataatttcttgagaacttttaagtgggaaatcttgtccacttattaaccatatataatcatattttatttttgaagtgaacacactctccatcaaattaacagtagcatcaatcatggaaatatctccccacttgacatcaattcttttatcatttggtaaaacaaaaatatgattatttttaatgatatcttcttctattgaactttttttatcaatatgaagaaaaaaatcacaattttttgaatccaacttctttatcattttatttatttgaccagcatttttatgacataaaacaatatatgctatttttatgtttgaattcattaactatttctccttctcgcttatttttatattacatacaatttctaaaaaatttatatacattatttcatattttttataatcccatgttagcatttataaaaaaacaaaacaagtttctatatttacaatgcaatgtaaatttcgcatatcgggtaattaccaccaaaatttataataattttttcaactcttgtagtataatatgtatgtttatctttttcacataatcttcctcaatgttattaagttaaagtgacattaagcatcttttactttatgttggatactttagctattttgttattttcatagacatatatcatttttttaaaatcaaaaaattgttcatttaaataatctagaaatctaagcatttccttttcataacttcgacttggtctgaaaccataactatactcactaaaacagtgttcacatattggttctatttttttaccgtcacttgttggataatcgtatccgtaatagttggtatacttagttttctaataccaggttctaggtttatatacattttgagcaaatacacctcatctactttgtaatgtcaaacatgtattagaaacatgcatttgttttgcactatttaatcattcagaacttcagtatactgtccatatccactatgccatttcctgacttcttactcttcgttgttactgctttgtcgctagtgaaatctcacgagttgtacatctttcctcgtttatccactggatttacacattaagactacggttttcttttggactttattgctttctctcttccataactcacagtgtggaacttgcaagccgctatatgattcatcggcaactatgctcacgaaagactttcaccttagatgcaaaatatgcccgtcatttacaaaaaaagagatcataacgatcccttaccataaacaacgcctttaatcgttttataaataatcgtaaagtctaaccaaatagaccaattatgataataataatcatctaatttacaacgataattaaattcaacatcacttctaccatttgcttgccacattcctgtaactcctggtttacatttaataatagaattgtaatactgacccatatctttcttttctcttggtaaataaggtctaggcccaattaatgacatttcacctaataaaacattaataaattgtggccattcatctaatgacgtttttcttaaaaactttcctactggtgtaattcttggatcattgactagttttttatttgtcagatattcttctttgatttttggatctttttccatcaattcatccaaaattctttcagcatcaggtaccattgatctaaatttatagattttaatcattttcccatttttaccaattctatcttgactaaaaataatactatcatgatctccacttttaacatatttatacttaacaaaaatcatcagtggtattaatgttaaacaacctactatcccagcacaaatatcaacaaatcttttcatagtattagcaagagccgtcatttcattatttgctgttgcaatcagtaattgtccatcaaaatcctgaacttcagaagaaaaagtcattgttccattaacatctggtaaatacttaatactttcaacttttccataaatatctgacatcaccttatcaattacttcttcacttgcttctggtaaagccacaataatttgttcaatttttaaagttttaatagcctcatccaattcttcataactatataaacaactatttctaatcacattttcctgtttaaaatcatataattgatctgtccaattggcatctacatatccttctactttagttaaagcaaaacgattgttatttgatattttaccaagtcttgctgcttcatatcctgttcctataaccaatgttcttctagcaaactgttctctaaaagcaattctaatatatctatcagctagtaaacaaataataaacattgaagctaccatgattgttaaatgcattcttctttcataacctgttgattttggtaccaacacaagtaatgcgatataaaaacaaaaacttgatttaactaatgctttaatttcatcccatattaagcatgtatttaatgaataatgtccatatataaataagaataggaaataaagtattcctgatccaatgattaaatctaaatccatatggaagtataaacatataaaataatacatgacaacttcgataagaagtaacataaagggcattaattttctattcatcttttacacctcttattatgtccattatatcgtaattcgattattaatgctatcttttctcttttatagtataatagatatatcaaaactttggagggtcaatatgaagtttttttatgaaggtatcaataaatttatgtataaacatccttttataaaatcttgtgtctattttgcatcaaaattttgtccttggatggtcgctatattttattcactctttttattaaaaatagtgatagaatcacaaactggtttttatcttttatttattaaaccatttgtcgttttattaattactgttctacttagaatattaattgatagacctcgtcctattcaaaagtatgaccttaaacctattgatgataaaaaaagaataggtcattctttcccaagtattcatacgagtttagctatttctatagctttgaccgttattgctcgaggaccaaatatgggattattactctcagcacttgctattacaattacttgtacaagactacttacaggtgttcactatttaacagatattcttgcaagtattttaattgcccttgctatttatatgatttaacgaaataagaaaattatttcgtttttttattttttaaaagaaaaaatgatttttgttgtctatataaataatgaagggagaaactatgaaaacaaaaatcaaatctaaaagaattaccgattttaaaaatgatcttgtatttaagtatttattatcaaatatgaaagatgaacaatgtaggcgtttattaaaacttatcatcgaagatgttatggatattaaatgtaagaaaattaatgtcttaaattcagagcttaatcctcatcatataagtgataaagatatgatcttagatattcaggtaataacagaagatggtgaactggtcgatattgaaatgcaaaacagtatattctctaaagaactctatcatcgtcttcaagcttatgaagctagaatgatcgatcatcaagtcaatcgtggagatgaaagatacagtgaccatcttcataaagtgaatttgattacttttgttaacgatattgataaagataatcttgtattgattgacagttatgtgcctagaaatgaatatggaaatgtgagaaagtttaacttagcaacaagctactttgtccaacttccatttattaaagttattgaaaaagaaaaaagactagaaaacttttcaagattagaaatcttaatctacatcttatatcatggacttacccatgatataatatctttagataatgaggtggtaacaatcatgaaagataagatggaacaattcaatgaagatgaagagcttgttttagcggcagaaaaaagacaacttgttaaaattcaacattatcatgaaggacaaagaatgcatgaagaaggaaaagctgaaggaaaactagcaagtaaaaaagaagatacattaatgctttttaaaagtaaatttcctcaagaagataacgaattattagaaaatcttactttacaacaatatgatcatatatttaaagcacttattgaaaataaagatttaaagacgatcaaaaaaatcattggaaaataatccaatgattttttaataacacacataaatataacgtccaaatttcacaaattctgttttcttccttaagatacgatttcttatttcaaaacctgcttgtttgatttcttgatccatttgttcataacttactaaaacaagtttattacataattttctagcactattaataatatcacactgttctttataagtaatcggtgtataaagattataaggaatatcaataatagcaatatcataatgtccttgatgcttattaatatcatcttttgtaatcaacataccatcaaaaccaaaatgattaagattacatcttgctttccatgaaatatcccttgaaatatcaaatcctttgatagaataccctaaagctagtccttctaaaacaactgtacccattccacaacaaggatctatcattgtttttgtttgatcattttctccagcaatattaatcaatgttctagcaagtctaatatctaaagaatttgaaaaagtatttggtttatcatcatattttttccatgatggaacaccatggtgataatacccaataatccataagtcattcacttttgtaagagcaattgtatgctttggtttggacatattcacactgcccgctataaaccatgaaatatctttacatttatcaagtgtttcttgataatctggatggctaataggattttttaaataaatgactttaaaatcttgatgattatgattttggcgtttaacttcctcttttaagtcatcaaaattggaacttatcgcccaaatatctatttttcctttcataaaaacacttatattgacatcaatatctttatttgtaataaaacattgttgatattcttcatgaaaaagatatttaaattctaatgcacataaatcatattcttctggtggataattaaataaataaaagtattgtttcatatttttcttacctctagtgccctattttaacaatacatcttcattttggctacttaaataatcataaatatgatatattatctccaggaggcgactatgaactatttaaaaaacttaaaagaacagtttacttttgatcaactgttattaatatttacatgttttagttttacttttcctttttatatattaggacctattttattgattgaatttatttatttgttagtatcaaaaaaagcaatcattaccttaaaacaaacaccacaaattaaatttctctatttgtttgttttaatctctttaagcatctccattattcataaaaatattttaggagcacttgcaacactaggaatatttattgctattattttaatggtttattatcgaaaacatattaatcaatcgacctttgaatttattattgatatgttgattgtgttatctattctttgggcaatatatggaatttatgaacaatttcaaatttatcatcgtttaggtgttgatcatttcacctttaaagtttatgcaagacgtgaaaatcgcttaaatagtgttttctacaatgccaactattatgcgatgatgattgaatttattgctgtaagtattgtttataaattctttaccgtaaaaaatgatttaaaaagaagtattttctatgttattgttggttttttaaacttatttatgctttatatgacaggatgccgtgctggttatgtagcaattgccggagctatttgtttatttcttatttttaataaaaactataaattatgtattttgatagctcttgggtgtttaggaattgcaggtttctttgttttaaatcctgataaattccctagaatagaatatttgatttcaaatttggatgttagaattcaaatttggagttgtgctattcaaggtatcaaagcttctccactactaggacaaggaccatttacttatatgatgattttagataaatataatggacatttaacacaacatgcccatagtgtttatttagatcctttactttcatttggaattattggactcgcatgccttgttccttatatttatgacaattgtaaacgtctttataaagtaaaagagcattattcttatattgctcttgttatgggatttataggtgtattattaattcatggtattttagattatacgattttttggatacacactggtttattcttcttatttgtattatctagttttgaaatttttgaaacaaatcgtaattagcgatttgtttttatttttgatatgttttatagattgttgctactacaaataaaagaatagataactctaaatattctatattaaatacatgtttatagacccaatcaacaatcataaaaagcattggtattcctacccaaacaattgtttcaattaattgatttcttttaacatccatcttgttcacctcttaacaaaatactactcctttttatgttaagaaaatatcaagcaagtgtaaaaaaaagaacttctttcgaagttctatgctcttgcattcattgtattttgttttaatgaattgacatattccatttgatgttttgtattttcttttaattctttttgcattccttctaatgtcatatgttctacttcttttgcttcagatttctttccacatactttttcaaatgcttcttttgcatcttgttgtaatgtgtttctcatttgatttctttgttctaatttcatttctgattctttgatttctcctacaacggattcaaagatttcttcttttgttaattcttttcttgcttcattttcatgttttacatctcatcgcctcatagcagcacctatgattaccatcaaatattattcgctctcaatacatattggtcatggcgtattcatgattgggcttaaatataagtaacgttactgatattactattctgctttcaatgtactctaaaaaagtctccttatatttcaaagaaattttcttttcatctataaggagaaaaaagcaacatttgtcacctcaaaaaaataacttttttattttctataattaacatataaaaaaagagtaatcatgattgtattattaataatcacaattactctatagattttaatctgttacatcatatccatttttttctaatattattcttagtttatctaatgctttagatattgacttgaatactgattgttttgtacaattttcctcttttgctattacttgtaatgattttccctctacatatcttttatatattcttttacgttgtactaaggtcaagttgctaatcccttctataattaattttaaaagatcatcatgaactatattatctaaatatgctgtatcttttctattaaaatcctctctatgtatttcaacatacggacttctttctagggaatagtatactttatgatatcttaattttctatcatacgctgattccatatgttcataactatcaataatttcaaatatttctgttgcaacttcaataaatatgtcctccttataatgttctgggtataataattttaaatttacaattattgtattcatttttcttttcctccttcgactaacggaggaaagaagagagaaagtaagcctaatttttaaacccgtattttctcaatttaaaagagtaaaaaaaaaagatagtcttcctgaaatgaatcagactatctttaccattaactttgtaaactataaattatacatttagtattaattttttatttttttacaactatttcgatataaatcaatattttttgtgaacactatactttatgatttacatatggtaaattattttctttaataatttgttcaaccccatcccaaatttttttatttttatcatttattaaagcaattaaattatattgatctataaaagtaatatttttattttttagataatttatcgcttgaattaattcatccctatttgtacctgttaatatattaaatatcgcatttttttcattttttattttaatattgaacattacttggtgtgcataagaaaatacaccaactctatttgcagctccacccataggtagacttgtaaagtagatttcaatactttctatattgtctaaataaatttgatgttctaattttaattttccaaaaacaatctgcggtttagaatacactcgaatcaaatgttcatctatctcccaatgagcttcttttttctttccaataacaaatttcataattaattcctccttttcaaataaattatattcataatcaaaagttaataatatatatattcataaacaacactattttttcatgaaatcactttaaaaacccaacatttcaaaaataatctcattactaaaaaatgccatacatattacaggggataaatttccttccataagagaaaagttatcagtaaattcaaagttctcaagtaattgatttaaaattttataaattttcaatttgttttcttcatcatttttattaacagtatctaaaattaagcaataattaaaaatataaccacttactccattaataaatgctttagtttcattcaaattagatatgtctttttttaaattttcaatatctatcattttttcaaaaaaattatattttttgtttccaatcagcttacaataatatgttaaatatattatcgttgtttgaactccatttccccatctataaatatttttatctccagcatacgtaatatttttatcactagatattctctctaaactatcaattttcccatcaaaccttaacattaaattatagtaaaaatcgattagtatattcatgccattcttggcttgactataattatattttctgtaaattttatataatatttgaagaacattaattaaaccatgtgccacacctaaatcaatataattttcattaaatatttctttcatttttttatcaatgtaattttcttcataaatcacaaatatattatcttgatttaatgataatttatttaattcagatacaatgtagtcaactactatgcagacttcctttttaatttggatatcatcatattgtaataaaaaagtcaaattaccattcaaaccattaaataggtcataccatcgatgattttgaatataatttccattaacaatatctctaatattttctaaaagtatatttttataactattaaaatttccatctttaattattccatattcatgcattttatttaaaatatacaaataactactatgcccataccaaaaagaattattaaacgtataatgcttgtaattcttcatatattcatcattaattttcaaaatcaatgttttatagaaattacttcctgtatctttatataggattaatagatatataataatatcttttgcataataaagatcaaaattattattatatattctttttaatagctctttattatactcatcaataaaactatttggttttagaatatttttgtctacttgtaattccataaaatatcctttcaacataacagtttaattcattttcttttcgtctatcaattcctaataagcgattaaaaaacatatgaaaataacttatcaactggtcattatcatagttttcacaattgaaatattccaacacttgattattgctattctctaatatactatatagttttgtacctaaagagctttttcttaatttaataaaattttcatccgggtacataatgttttcgataaatttgtattttttttgatattcccttttattaaaatttatagtcttatacatacttaaaacttgtgaaacatcttgatgtaaattaaacaatatataaagcactgtcataatatatagactttctttggtgtaatcaattcttttttttgttaataaatataacaattccaatgaaaaatatgtattttcgcaaaacattttttcaaatctttcaatatttccataaccatatctttctgtctctctttcatatacattaatagaatatttctctacatatcccatatctttacactttaaaataaattcgttaaaatgtaccataaatttattaatatacgaagattttactcttaatctaatatgtggaagttcatctatatatcttatatagaaatattctcttataaatgaataagttttttcatgtaataaaaatggcataagatagtttgttaaaaattcatcttgaaaataatcctttacataaatattaaaataagtccattcgttaaaaggaaataaggtacgattactttctttactaaaggacaacgtctcatgaattgtataattagtattatctccagcaaattgaaaaataagctccgaaacatgtttttctccgctatcatttataacaatcaagtcattatcagtaaaatagttttttactaatattccttttggactagatttaatttgttgaaataatatttttttatgtaaatcattatttaaatctaacaaaagtctgttatccatatattcaaaaaacaccttactaggcaactgatctgtttttattttttcgtccaattttgtacaaaaaatctcataactttgtttttttgtaagatttatcttattgttatccaatttccatttttgtggactaactactacgttcttatatcgaatttctggtagaatatcaaatccttctaaccatctattaatcaaattaaaaaaatacaaattattttttatttttctttgagaagaatcaagaataaaatttaaaattggtggcataaaatctcgtagtgctttattatttgcgttaaaagcaatttgttttcctgttatattgttataataaaaaaattcatttccgttagaactaacactaatatcatcaagggttaatctagttttcccaagaatattagtattggttgtatattctaaatagtaattacaatctgttgtacaatttatcacgttttgcactctactatttttaggaatatatgttatctctacataatcaatatcctctttattaaaaaatttagaattattttctctgaatatataattaaatctaccaaatgattcaaataaattatttgaagcacaaaatggactagtaatataatttaattctgttccgtttaaaattggatagaacgccaattccatgttagttctatatttctctttatttttatcctcaaccataaaatttgatagatctataacactaccactttttatattttcattaagataatgtataagcctttttccgttatcagaaatttcttcatttcgaaatattttagttggtaatcctattcctttatatttatcaaatgcatattttacaggaacccttacattcccaaacttatcaataaaagatttacaatgattaatgtacttatcttcatcattagaaaaactatttataaaatttgcataatcctctaatttctttttttcttcaatattaatatctaaaacagattcataataactatcaactctaattatatttttacaattatatacatctttcatttcatttatcaatctttcatattttggaattgaaaaatctatatttagattgcataaatcataatagaattttcctagtttttctagtaatggagaatgataattaaatttttctcctgttttaattatttctttcaatggatcatttataagtgggcaaaaacgtaaattgcttaccaaaatctcatatttttgtagttgatcaagcaatttacttatatcacttaatctttctgagccatatatttctaatagattatttattaaatcttctttttttatatatgattgtgttaattctaataccttttttacaacacttgtattattaataattacttcattcgtattcttgtttgtttctaaataataatgtgtaacccagtggttaacaatttttttatcattttcttctatatctttatttttaacaacgtaaatgtcattacgtatttcttgttctaatttaggtaaaattggtagcaaccattcattatctaccctaaaatataatttaggaatatctatgttataattgtttttgtttgtaaatcttcccaatcctactccacttaacgaactatatggtgtacaacgtgtagatgaacgtattatatattttaaaagagagcatatattatcatctttgcaacctttagaaagagttgcatacaatgatgaagatgttaataatatatcttgtttaaatgtattattataaaattcattaaataacgtatagttattttgatttgctaccttttcaaatttatcaaatgataagtttgcatatcttacatagaaattatctagacataaaattttatttttttccacataatcaccccatttaaatatatctattattttatattaattattgacatttatgttaaatacctttaaattattatatgtaatttacataacatagtagatagtagaatgtgatggtattaattaattttgaatatactttaaagttgcgatttaaagttcataattatatcatcacatttctactattagtttatatttaataatactgttaacattttgattctgtgtatcccggatttgtagaaagacttgttgatacttgtgataataccgaaataacatctgttattatctttcctttttccttctttcaatggacggatagtccaatgaataattgtttcttatataataaaagcctgtcaacaaattattttatcaacaggctaaatacatattattaatctaaatcagcaccgtttgattcgaatgcttttttgatccattgatatgattttttaggaatacgtttcatatctcttaaatctttatttgttctatttacataaacaaacccataacgtttatccatattacacatacttgctagaatatcaattggtccccaagtaatatatcctaaacaatcaacaccatcttcaaagattgcattttccatttctttgatatgatctctatgataattaatacgataatcatcttcaattgtacgaccttcagctaacatttgatctacttcttcttgactcatatcttcacgccaaccaataccattttcaagaacgaatactggaagacctgttctatgatgtaaatcatttaatgtccatctaaatccaactggatcgatttcccaatcccattcatttgcttcacaatgaggatttttaatttgtttttcatttacacattcatgagctggtctttcataatcaaattcacctgttttaacagtgtttgaacgataataagagaaagcaatataatcaacagtgtattttaataattcttcgtcaccttcttcaaaagtaggcatccatcctctattttcaagataagcattccaataatcaggatatttaccttgagcaaatgtatcaactaagaaaccatttaataaattatatcctttagtagcaaagaaattattttctggactattttcataagcataaatattagtaatagcacccataccacagaatttagcatctggttgcatttgtcttaaagcacgtactgctttacagtgagccatcataacattgtggtttacttgatataagtgttttggatagctaactccttcaggaataacttcagcattagaaacacgtaacatcatactgtgtaagttttgttcattgaatgacatccaatgtttaacacgatctccaaatctttcaatacaaactttagcatatctttcaaaacaatctacaacataacgagatgcaaatccattatattcttttactaaatgataaggcatatcaaaatgaactaatgtaatcattggttcaataccagcagctaataatttatcaattaaatcactataaaatttaactccttcttcatttactggttcatctaatgttccattaggaataatacgagaccaacaaatagagaaacgataaaagttgaatcccattcctttcattaatgcaatatcttcatcataacgagtatattcatcaatagcatcgttccaatcagaaaattcaggattcataggtcttacatcataaacacataaaccttttcctccttcatttctatgtccttctgtttggaatgatgaaactgatccaccccaataaaaatcttttggtaattttctttccataaaatgttctccttttttatatccacctaacattttaatcatctcatcttgaaagtaaatatcttcgatattcctttttataatgtttcatatttaattaaaataaaacccatttcatgaaactttgttccatgttatactataaacggtgatataaaatgagtataatgacacaattagaatttgagttagatttctctcattcagaaaaagaaatcgcccattatatattaaacgagggagaaaaagttttaaatctttctatcaaagaactcgctaaaaaaacatatacttctccagctactattgtaagactttgtcataaattaggtttggaaggttatggtgattttaaaatcaaatattctgctgaattacaatttgatttagctcatacagatcgtatagatgttaattttccctttaatgaagaagataatgattccatggttgcttataaactagctagtttaaatcaagaagtcatcgcggaaaccatccaattgattgattttgaacaacttcatcaaatagttgaactacttgatcaaaacaaagatatcgatatctatggaacaggaaattcattacttgcagctatgtctttccaacataaaatgatgcgaatacaaagaaacgttaatctcaaaatgctcgctggagaacaagtctttatgtcttataattccaatgaaaacaaaatagcaatgattatttcttattcaggggaaaccaatgaacttattaaaatagcaaaaatattaaaagaaaagaaaacacctatcattgttttaacttcaattggtgataatcgactttcccattatgcaagctatattttaaatattggatcacgggaaaagatttttaccaagatagccccttttgcttcacaaacatcaattgaatatattttaaatgtgatcttttcttgtttattcaaaaaagattatcaaacaaacatccaaaataaaataagctatgataaagaaaacgatgtccgtcatcctttacatagccctgttaatgatatcatagaataaaaaagggacaaaataaattttgtccacatggtaataatctttgaagattattacctttttctttaaaccccttaataatttagagcgaatttcgctaaagcactcgattatttagagcgcctagataactaagtaacacttctaaatattaatttatttattaatctatagcattagcagcatgataagctgttctaatagcacttgctatatcagcagttctttcaccagaacaatctcctacacatacatgaggaattgtaatagatgaatcatcaaagatatttttctttgatcctaaagcattgataattgtatctgctttgatttgatcatttgctgtatagacaatattgttttcaatatgatctacttttgtatttactaattgcttaacattatgatctgcaaagtctttcatcattaatggtaaaacagttgtagattcaccagcagcaattttatccatcatttctacaattgtcacttgatgacctttatttgctagatattcagcagtttcagcacctactaaacctccaccaataaccacacaatcaccagtaacttcttgtccgtttaaaacatcccaacttgaaacaatattgctgttatcatgaggaattggcatttccatattatgtgcccctacagcaataatagcataatcataactattgatatcttttgcttcttcatttaaatgaatatctacatttaatgtaggtaatactttttgataatattcaacacttcttaagatttcattttttcttggtggaacagaggcaatattgatttgtcctcctaaatgatctgatttttcaaataaagtcactgtatgtcctttaacagcagcaactcttgctgcttctaaaccagcaattcctccaccaataacaactactttttgaggattatttgttggtttaattgaaacagtagcttcatttccattttcagcatttaaaacgcatgaaatgtattgtctattttgaattgcatcaacgcaccctttattacagtttaaacattctctaatgcattctccttttttcacttttaaagcaatatcaggatcagttaataaagaacgtccataaccaatcatatcagcgtctccatcatttaagattttttcaccagcttctacacttaccactctacctactgttgctactggaatagaaacaacttctttaacttttctagcaactggtaatgtccaattatatggcacatctcccattggtggaatcgtatcacccatatttcctgtatggttggcttgagctacttgaatcatgtcaacgcctgcttcttctagttttttcgcaaaagcaattccttcagcttcttttaaaccacctttacctcttaaacttccatctttatttaaagtaataattggaagtttatattcaattgtcaaatcaggtgcggcttctttaattgctttaacaacttctaaagcataacgaattctattttcaaaagaaccaccatatacatcacttcgatgatttaatacttcagaacataaagaacctaatagtctatctccatgaacttcaattgcatcaattcctgcaatcattgctttatgagcacaacttgctatactttctttaatttgatttaattgttcaacagttgcttctgaaacaaaatgttgcatatcatgatgtaatttagcataagcatcttttgtaagcttttgtgctaattctgtttgttttaaagcttcttcttcatttccttcagcttttgctttagccgcattttgacgagctattcctgcttccataatcatttttccaacaccaggaacatcatattctggatggaagatttgtaaagccactttacaatcatattgatgtaatgtatccgcaagttttttaaaggctggtatttgttcttcactataaagttttggtgttggtgatgctgtacgtacaggagctacgtcaccaataacaacataagaagctccacctttcgctaatctttcataaaaacttaaacttttttgaccaatagatccatctctttcttcataccctgttgtaagaggtggaaacataattctgttttttaatgtcattttccctacttggattggttctaatagtttcatattattatatctcctttgttatttgatatgcatttgtaatagcatcttttaatgttcctactttttgacaatcaccaattaaatgagcattttcaattggtgaagcaactggattatagccaactgcaaaaactaatgtatcaacatcatctaaaacatattcttgatgattcttttcatatttaatagtattttcatcaacataagtgatctttgaatttaattcaatcttcacacctttttccatcatacgtcttgtaagcaatgatttcgttgctccagattcccctgtcattaatcctttagtcatttcaattaaagtaatatctctatttgtagggaataaatcattaatcaatggtgctaaataatctgctgtttcacaaccaacagaaccaccaccaataattacgatctttctacctggaaattttttaccagataaaatatcatcagccgtcattgtttgtttaaagactttataaggttcgatttctttaggtgttgcacctactgttgtaataatttcataatctttaaattcattttcaatcatttctttagtcactgttgtatttaaacgaacatcaacacctgttaattggctcttcatatatttaactactttagtaatttcttgtttaccaataggcacacaagcaatatttaattgaccacctaaacgatcactttgttcacataaaacaacttcatgtccacgttttttagcgacataagcagcttccattcctgctggtccaccaccaacaacaagtacttttttcttaacaggagcttcatcaatttcttctttttcaacagctggattgactgtacaactaattggtttaccaaacataattcctgttaaacatcttccacaaccaatacatggtctaatttcatctatttttcctgcttttgctttgttcgcaaattcactatcacataaattaggacgaccaatcatacacgcatcacaaacaccattagcgattaactcatctgctacccaaggttcgttgatacgcgaaactgttgccactggaatagatacatgttttttaatttcttcacttgcatgtttatgtggtgccggagctgttccacttgctggcattgaacttccttttttaatggtatttcctccagaaacatgaataaagtcaacggttgctttttctaattgtttagaaacatagatcatatcattaagtgttaaaccaccatcactgtattcatctcctgaaatacgcacatcaatgataaaatctctaccacattgttttcttacttcttcaataacttctaaagttaaacgtaatcttccatgaatatctccaccatattcatctgttcttttattatataaaggcgttaaaaatcctcctaataaaccatgtgcatgggctgcttggatttcaactccatctccccctgcttttttaaaacgtaaagcagcttcaccaaattgtttaacaattacttttaattcttcttttgttacttctcgaggggcacttttagcataatatggtcctacattagaaggagcaatcaattgtggtgtcccaggaattggaaaagccatataagctggatgaaagagttgtgataagattttagtatcatattgatgtactgcatctacaagttttttccatccaggaatataagaatcatcatagattgacatatctcctggtaaatatgtatatgtaggttctacagttgtaacttcagttacaataagtcctactccaccttttgctctagctgcatagtgctttactaaggcatctgttacataacctttatctgcaagattagttgataaaggtggcataaaaatacgattttttactgttgtatttcctattttaataggtgtaaataaatgttcataagtattcataataagtctcctttttcctcatgtttattttatcacaagcatttcctaaaaacgttatcatttctagctatttacatctattttttgtcatcaaaaataaaagcaaggacaaaatatcgtccttgccagcaaataccattaagcttcaaaatatttttttatttctaaaacttcatcttcagaaacttttaacaattcaactgcttttgaaaacgaaatacttaagctattcatcaaatttgttattaattcaatatttttctttcttctttccaatttttgtccttgttcaagccccatagaatgtcctttttctatattttctctggttatcatttctcctaaattacacatctttttaacctccttctctatttcttcaaatccccttaataatttagagcgaatttcgctaaagcactcgattatttagagcgccttatttttgttctttagagtcttttaacacaacatcatgtgcgccaccttcaacaattgaagtagctgatactaaagtaattttagctttttgttgtaattcaggaattgttaaagcaccacagttacacattgtatgtttaatttttgataatgataaaccaacgttatcttttaaacttccagcatatggtacataagaatctacaccttcttcaaaagaaagtttagcatctccccccatatcataacgttgccagttacgagcacgagcagaaccttctccccaatattctttcatatattgtccattaatttgaactttatttgtaggagattcatcaaatcttgagaaatatctacctagcataataaaatcagaacccatcgctaaggctaatgtcatatgataatcatgaacgataccaccatctgaacaaattggtacataaattcctgtttctttaaagtattcatctcttgctttagctacttcgattgttgctgtagcttgtccacgaccaatacctttttgttcacgagtgatacaaattgatcctccaccgataccaattttaacgaaatcagcaccacattcagctaagaatctaaatccttctgcatcaacaacgttaccggcacctactttaacagtatcaccataattttctctaatccaatcgattgttaatttttgccattctgagaatccttcagatgaatcgatacataaaacatcagcaccagcttctactaatgcaggaacacgtgtagcatagtcacgtgtgttgattccagcaccaacaatgtaacgtttattttcatctaataattcatttggattgttttttctattttcatagtcttttctaaatacgaaataatgtaatctttgttcagcatctactacaggtaatgcatttaatttgttatcccaaatcatatcattacattctttaagagatgttcctaaatctgcacaaattaatttatcatatggtgtcataaaagtttcaacttttgtatccattgataaacgagaaatacgataatctcttccagtaacaactcctaataatttaccgttagcagttccatccgctgtaactgccattgttgaatgtccagttttttcttttaaatctaaaacatcttttaaagttgattcaggtgataagtttgaatcacttggaacgaatccagctttataatttttaacacgtcttaccatagctgcttggctttcgattgattgagatccataaataaatgaaactccaccttctttagctaaggcaattgccatattatcatcagatacagcttgcataattgctgaaactaatggaacatttagtgataatgcaggttcttcaccttttttaaatttaactaatggtgtttttaaacttacgttttcagcacgacactcagctgatgagtatcctggaactaataaatattcattaaaagtacgcgatggttcttcaaagtaaaatgccatttttttatctccttattctttctatatttttgaaaaattataatccccaaatttaaataagtcaataataaaaagaaaaagtaggtttccctactttaaagcattattcatttgttgattgattgtttgtaagatttcattcacttcattttgtaaatataaataattaacaactaatggatgattttcataatatgcttttttttcttgatattcttgaattgtttttgtaactcgatcatcctgttttgctttttgattgacaatctttttttgtaatacttttaattctttttctaattgtttaagtttttcatcatttaaaacaagtttttcatacttttgatattcttgaacaacttctaaagctaaaatttcttgatttaattttctagcaagctcttcaattctagtcaacttgttcaccttttaaagcccaagtttttacttctgtgacttttacaggcacaattttaccaatatcttctttacgccctttgaagttgatcaatttttgatgtgccgtatatcctgtcatcattgtttcatcacgtttagatggaccatctactaaaacatccacaacttgatttaagaaacgttgattttgttttaaagctttttctttaacaacttcatttaatctttctaaacggtcttgtttttgttcaaatggcacattgtcttgcattttagcagcaggtgttccttcacgaggagaatagataaatgtataggctaaatcgtattcacattcttcatataaagaaagtgtatcttggaattgttcttctgtttcatttgggaaaccaacaataatatctgttgtaattgaacaatctggcatcacttctttaatcatgtggaaaagttccaaatattgttctcttgtatatcttctacccattaatttcaagatttctgtatttcctgattgtactggtaaatggatataaggcatgatgttatcatattgattaatgatttcaatcatttctctagagaagtcccatggatgacttgttgtaaaacgaatacgtgcaatccccgttttagcaacttcctctaaaagagtcgcaaaatcataatcttcttctaaatcttttccataactattgacattttgtccaagtaaagtgatttcttgatacccatctgcttttaatcctttaacttcttcaataatatcatccattaaacgagaacgttcttttcctcttgtataaggcacaatacaatacgtacagaatttattacatccatacatgatattgacccatgctttatgtccattagcacgtgtaacaggcgtattttcaataatatccccttctttagaccatacttctacaaccatttctttactaaacattgcttcttttaataaagttggtaaacgatgaatattatgtgttccaaagattaagtctatatgtggatgtttttctaatattcttttaataacaacttcttcttgtgccatacaaccgcataaaccaaaaataagatttgggtttttcttctttaagtttttaacataacctactttcccaaatactttttcttctgcattttctctaatagcacaagtatttaataaaatgacatctgcttcttcgatttctttagcagctgtatatcccatcatttcaaaaatacctgctaatgtttcaccatcacgttcattcgcttgacaaccataagtatgaatataataagtttttcctttacctacacttaccatatcactaggtatttcaaaagcatcttttaaatgatcaacttgttttctacttcttttttgagcctcttttaaatttggccctttaaaatattcactataatctttcattttttcaccacatttctttcctattatatacataaagttatcttttggctagaaaaaaataaggacttatcagtccttatcatttttatcttatccaaagaatccgtctggttgaattgagaagtataatactttaccttctggagttcctttaaatactcctttacaatgacctgcagcttcttctggtgataattcagtttcacattcaaattcagctttgattcctacttttttaacatatttacatgatactttatcatctgaatatccatcaaagaaatcaataattttttgaacttgtcctgtttgcattaataatttacattttgccattttaaaaaacctccatttacatgtcagtattatacaatgaatttttaaaaaaagaaacccttttcactaaaaattaacgtaattctattacaagtcttaaggcagtaatccttttatcatcgaccattaaatcatgaaaagaaggaatacaaataagttcttttcctgttggaataatataacctcttgcaattgcaattgatttaattgcttgattaagtgctgctgcaccaattgtttgaatcataagtttatcttgttccctcattaatgatgctattgctcctgcaacgtgattaggaacagatgttgaagatactttaattatttccatatttttgcctcctaattcactatatgaattatcattaaaaaaataacaaaaaaagcatcctaagatgctcgatatggatgatcatcattgattaaaactctttcaatagagataggttggtgtttgtcattaaattcaataacaactccagcaaactgtcctgaattttcagaaattaaaaactttgaacttagacctctcatacgtgtaatgacactatctaaatcacatcctaaagaacttaaataagggcccgtcattcctgcatcagaaataaatgctacttttttatcaataattctttcgtctgctgtttgtacatgtgtatgtgttcctaagaccgcctgtactttatctttacaataataagctaaacctattttttcactggttgcttctgcatgaatatcaatgatatgaatatcttgttcaaggtttagataatcatcaatatgatcaaaaggattcgaataacggttatccataaagacacatccaagtgcattggttactcttatttttgtacctttaacattaaatactcttgtatggactcctggtaaaatacttggttgattgaaaggaacaacaaggcgatcagcttcatcaataaaatcaagaagttcttttttatcaaaagtatgattccccattgtcatacaatcaacaccttcaaaagtaaagaaatcataatgttttctatttaatcctttaccatgtgtcgcattttcaacatttgcgattacaaaatcaatttgataatcttttcgaatacgataaagataatcttctatcatttgtcgtcctacatttccaacgatatctcctataaataaaactttcattttctttcctcatttcgtaaagacattttaacatatataaaaaaaaagggaattgatttcccttttattttgcaatttcactcgcacgaatttctcttataacagtaactttaatatgtcctggataagttaattcttcttcaatctttgtcttaatatcacgtgcaatcttatgacttgctagatcatccactttatcaggttttacaacgatacgaatttcacgtcctgcttgaattgcatagacacgatcgacaccatcaaagcttttagccatttcttcaagtttttcaagtctttgaatataattttcaattgtttcacttcgacttcctggtctagcagctgataatgtatcagcagcagctactaaaatagaaataacacttgttgctggtacatccccatgatgtgaagcaattgcattaataacagttgaatgttctccatgttttttcgcgaattttgcacctaattcaacatggcttccttccatttcatgatccattgctttaccaatatcatgtaatagacctgcacgtttagctaattgttgatttaatcctaattcagcagccataatccctgctaaatgtgcaacttctaatgaatgttgaagcgcattttgaccatagcttgtacgatattttaatttaccaatttgtttaacaatttctttatcaatacgagaaatacctaattcaaaaattgcattttctccagttttacgaataacttcatctaattcttttcttgttttatcaacaacttcctcgattcttcctggttgaatacgtccatctctaattaaagtttctaacgataaacgagcaacttctcttcttactggatcaaagcaagaaatcgtaattgcttcaggtgtatcatcaataattaaatctgcacctgttgcttgttcgattgctttaatattacgaccttcacgtccaataatacgccctttcatttcttcacttggaagatcaacaacagttactgttctttcagtaacttcctcttgagcatatcgattaattgcattggcaataatgtctctagacatatcagcagctttgcttttagcttcttcttcttgttcctttatgtaagcagacatttctaatgaaatttgttgttcaacttgtttgaacaattcttctttagcttctcttgctgacatagcggcaactttttctaattcaacaactttagaatcaattttatcttttaattcagcctctaatttatctattccagcttctttaatatctaattgtttaattctttgttcaagaacgtcttctttaccttgaacagcaatatctcttcgttcaatacctttttcacgttctgaaagattattttcaagttcagtaatttcttgtttttgttctttaatttctttttctgcttctaattttaattcataagcttgagttttagcatctaaaatagcttctttaactagattatcagctttactcgttgcatcatcaataatcttttgagcactgacattagcttttgaaatatttagttttgcatatacaaaataaataagaaccccaacagcgacagctagaacataggataaaatagtggcaatatttaaacctggcatattccaccctccattttctctatgcacattttttatgattgattattcaatcattcaccggttgtttcggttataataattaatatttacatagtctttactatgtttattaaacgtgttttgcgcacaagtatattatatgtcaaattgcttattttgacaataacaagttaaaaagaggaatttttacaattcctcttcttctacagacattaatgaagctttaattgcttccgtaatttcattcattatatcaggatgttcaacaagatatcgttttgcattttcgcgtccttgtccaatcttttcacccttataagcataccaagcaccggatttatcaacaatatctttatcaactgctaaatccaagacttcaccatctcttgaaatacctttaccataaataatatcaacttgtgttgatttaaatggtggtgccactttatttttaacaactttgatattgactttattcccaacaatttccgtaccatttttaattgcttcacttcttctgatttctactcgcacagaagaatagaattttaaagctcttcctccagtagtcgtttctggatttccaaacataactccaattttttcacgtaattggttaatgaaaataattgtacaatctgttttattcataacccctgaaagtttacgtaaagctttagacatcaatcttgcttgtaatcccatttgttgatcagccatttcgccatctaattccacttgaggaacaagtgcagcaacagagtcaacaactactaagtcaatagctccagaacgtacgagtgtttcagcaatttctaaaccttgttcaccactatctggttgcgaaagaatcaattcatcaatattaactcctagatttttagcataaacaggatcaatggcatgttcggcatcaataaatgcagctgtaccaccttgtttttgtacttcagcaattgcatgcaatgtaagcgttgttttaccacttgattctggaccataaatttcaataattcttcctttaggataaccacctattcctaaagccatgtcaagtgttaaagaacctgttggaataacagccacatcaacagctgcacgatctccaagcttcataacagaaccttttccaaattgcttttcaatttgtttgattgcatcattcaatgcttgtgcttttttagcatcttttgtttctacttctttttttccagccataaataatacctcctattcctatatatgctttatttttcattttttcttttatttttttaaaattttttcaattattttcttttgagcaaaatctactgcctttaaagcaatctcttttcgactaccttctaaattcaatttataaacaacaacatcttcataagcaataccaatatagacttctcctactggttttccttccattgcatccggtccagcatttcctgtaaaagaaacacatagatcaacatctaaaatacttttaccattaacacacattaaagtagcaatttctttagaaacaacaccgtacttttcaatcaatggatgttcaattcctaaaagcctttctttcgtttcactttgataagtgactaaagaacccttataaaccttagaaatgccaggaatatttcctagcattgtcgcaaaatttcctactgtaaaactttctacagttccaatagaaatattattttttattaatagttcagcaaattcattcattacattgactccgttaacatatctttactatccataaaataatcaataccacttactattgaaatcacgcaagcaatccatacacttatttgaccaattggtaaatgaatgattgaaaaaggaaaatcatttaataataagaatatcacactgatcatttgtgtcacagtttttaattttcctaaatattttgctgcaataacaacttgtttattagcagccaccaaacgaatggcatctacgatcgtatccctagaaatcataataataggaataatgatagaaattgtcccatcacttgctagtaaaagaaaaatcgtattaattaatagtttatctgcaatcggatcagcaaacttaccaaaagttgtaattaatttagattttctcgcaatttgtccatcaaaataatcagttaacgaagcaaccgcaaaaataataaagataacaatattaacaagtgaaatatcagcattcaaaatatgatacataggtacattgattccaaacgttgcataaggaaacatataaataagaataagaattggaacaaggattattcttgtaatcgttaatttattaggtaaattcattatttgaccatcgttaatttaaatgttcttactctaccattagagcttgttccataatgatcattttcttctaatggaattttttgatcattaatataataacgatgtcctaagttccaactatatgaaaattccaaatattggaaatcattcacattaaattctagttcaacactttcacatgcagaatcatcttttaaagcatctgatgctgaaatactagcaagattactactataaacaccttttttaaatgtatcagtttgataactgttaggatcaccattaacatgtagatcaacagttgtcgcaaatgtaaagtctacttttaatttaaaagtttcttgatcatatccatcaggtaatttaaaactataatcaccatcagcatttttagtaaaagttatttcagtagatgtttgttcatcttttttcgttgtatcagattttgttgttttctttttatctgtttctgttgttttcttctttaaagtttcacttgtttctgttttagatgtattactatttttaaatgatgaatcatttgatttcgtaaagacaaatgaatatccaagtacaataataatagcaatgacaataataatgacaattgcatatttaatatatcttaagatatagtgatcttcataaactccctttcttgtcggttgttttttagttggttgaatattttttactttatctacaaaagtaacagatcctatatcttcttttttattttctaaatcttttaaatcagcctttttaatttctctcgtaattgcataataatcatcagcaatcgtctcatctatttctaagtatcttgctatttttttaagatacatttttacatatagctcgtctccaacaaatcgttcaaaagcaccgtcttctatatctttaatgatattaacagataacaatgttgcttctgcgacttcctctattgtaacgcctttggcaatgcgggctgcttttatcttttcacttattttgtccataaagacatcctcctttacacttaggcataattaaacaaataaattatagcacaaatgttttatttgacaaatacaaaagctcattttatttctaatatattatatacataaaaaatgtcttttttatgtccaaaaagaaaaaaagcttaaaaaagctttttttataacgtaataattccaaatgttgataaaatataacttaataaaataattaataatgttggaatgcaaatatatttcatcacaatattatagactttttctcttttaaaagcagatgatattttaatttcatttgaaattgtttttaattttgttacaaaaataattaataaaactgtacataacgctgaaattggcatcatgcatgaatttgtgacaaaatcaaagaaatctaataaagtcattcctaatggttgaatccatcctaaaacaccatagccaagtgaaataggaattcctaaaactaacatttcaataatcattgctaaagctgctttttttctagaaatatggaattgttccattaaagttgcgactgaacattccattaaagaaatagctgatgttaaagcagcaaataagacaagtaaaaagaatacaccaccaataaatccacctaattgaagtgaattaaatacttttggcattgtaataaacattaaagacgctccagcatttaaactatcttttcctgaaaatgcaaagactgcaggaataatcattagccccgctaaaaaagcaattaaagtgtccataatttctacttgagaaattgctttttccatatcaacatcttttttcatataagaaccatatgtaaataaaatacccattccaattgataaagaataaaacatttgtcccattgctgaaataactgtcataatactaaaccttgaaaaatcaggaataatataatacttcaaaccttcaattgctcctggtgtcattaaaccatagattgaaataaaaatagctattactactaaaataggcattaaaatcttacttaccttttctattcctttttctacccctttaataaccacaataaaagttaatactgcaaaaacaactaaccaaaaagctggactaattggattagcaataaaatttgaaaaataggtatcttgtgtcaagatttgacttgatcctcttaaatattcaaataagtatttacatacccaaccaccaacaacacagtaataaggaattatcaacattggaataattgaattcaaccaaccaccaatctttaatttttttgctcctaagattttatatgctttgattggattgtttccggtctttcttcctaatgctgtttcacttacaagtaaagcaaaaccaactgtaaacgctaaaataatgtaagtaaataaaaaagtacctccaccatatttagccgcaagatatggaaaacgccaaatgtttcctaatccaacagctgagccagcagccgccataacatatcctaaacggcctgaaaaacttgattttttatttgtttccatcgaatttcccctttttaacatataaaaaaattatattgaaacctcataaaaagtcaactttattgtgaaattaataacaaaattctctttttttttacattttaaaacaaaaaaacagccctcattgaggactgtcttattattataataatgatttatataattctttgatttcttctacacttgtatctcttgggttacctggacagcaagcatcagctaaagcagattcacttaagaattgtaaatcttcttctttaacgatttcttttaagtcagctggaataccaacatctttagataattgtttaactgcatctacagctgctttacgatattcttcttgagacataccagtagtatctacacccattgcttctgcaatgtctttatatttttcaccagtatatggtgcattatattccataactgttggtaagatgatagcattagcaacaccatgaggtgtatcatataaagctccaagtggatgagccattgagtgaactaatcctaaacctacgttagagaatcccatacctgcaacatattgacctaaggccataccttctctaccttcaggagtattttctactgcacctcttaatgatttagaaataatttcgatagctttgatatggaacatatctgacatttcccaagcacctttagtaatataaccttcgatagcatgagttaaggcatccatacctgtagcagcagttaatccttttggcattgatgacatcatatctgggtcaacgaaagctacaactggaatatcatgtacatctacacataccattttacgatctttttcaacatctgtgattacatagttgattgttacttcagcagcagtaccagctgttgtaggaactgcaaagattggtgtacaaggatttttagttggtgcaacaccttctaagcttcttacatcagcaaattcagggtttttatcaataatacctactgcttttgctgtatccattgatgaaccaccaccaatagcaatcatataatctgctccagcatcatgtaatgctttaacaccttgttgaacattttcaattgttggattcggtttgatattagaatatagttcataagctaatcctgctttatctaataaatcagtaacttttgctgttactccaaattttactaagtctggatctgaacatactaaagcttttttgaatcctcttgcttttgcttcttcaggaattgattcaattgctccttttccatgataacttgtttcatttaatacaaatctgtttgccataattaaatctcctcttttctaactacacatattttagtatcatgtgaaaataaaaacaagttacacataaggctatgtgtaacatttcacaagttttatatcatttttatcccattacaaaaagctataaatatgtcataatagaaacaaggagtgacatcatgaaatattatgctgtaaaaaaaggaagacatcctggtatttataatacttgggaagaatgtcaaaatgaagtaaatcagtttaaaaatgcgcaatttaaaagttttacttctaaagaagaagcttggaactatttaaatgaaaatactcaaaaaacagataaaccatcacttagtaaagatcaatataatgcctataaccaattaatatcaggtaaaaatatctttttaaccggtggtgcaggaacaggtaaatcatttgttttaaaattatttatcagtgaaatggaaaaacaaaataaaaaagtaattgtctgtgctcctacaggtattgctgctattaatatccaaggtgtaactattcatagatgttttcaagtatcccctgagccacaagttattaaacatatccaaaaagtacctcaagttgtacaagaaagcgatattatcattatagatgaaatcagtatgtgtcgtgttgatctttttgattttgttgtaagaacaattactaaggcagaagaaaaatctttatctcgtaaacaaatagttgtagttggtgatttctttcaacttcctccagttactactgataatgatcgtgaagttttagaaaaaatatatggacattatcataaaggctacgcttttgaatctacaaattggaaagatttagattttcaaacagttgaattaaaagaagttattagacaaaaggatcctgaatttgttcatgaacttaataaagcaagaataggtgactattcttgtgtaagttattttaatactcatagtcaaaaagaactttttgaaaatggaattattttaactgctactaataaaaaagcagaacaaatcaatcaagataaactctctaagttacccaataaagctaaagtctatcattctagaatagtaggagatgttaaaaattctgataaacctactttagatgaacttcatctaaaaataggagctagagttatggtactcattaatgatactgaacaagatttatatcaaaatggttcatttggaaaagtatataaattagaagatgattgtgtaacagttatgcttgatacaaataaaacattagttacttttggatatcatgaatgggctatagaaaattatgttttgtctaaaaagaaagatggagatattgaagatcatcaactatctaaagaaaaagtaggtgctttttatcaaatacctttaaagcttgcttatgctattacaatgcataaaagtcaaggacaaacttatgatcaagtcaatttaatcccctattcatttgataacggtcaactatacgtagctttaagtcgtgttaaatctattgaaggtctttgtttaattaatcaattaagacaagagaatttaatttgtagtcaagaagtcaaagatttttatcatattggttcatctaaaaacaaagataatcttatttatgaactcggtaaaaaagtactagaaacttatccaaaagaaattcaagatttaatagatgaaatacataaaatagatagaaaaggataaacatcgtatttaagatatgtttatccttttcatataatgtattattcagttaattaactttcgaatttcttaatttctttttcaaacattcaattatttttgtttctttattaatactagttatttcacatttttacttcttataattttttacagaatagtattttatatttgtaaaaatttttttatatttttctaacaaagtacctactataccgctttttaaatcctttattccaagattatcacttatctgacatatacattttccctctctagttaaatgagataaatcttcaataaaagtatttattgaatttatttttccatcctcaatcattgaatctaaattaaaatgcaatacatcatcatattttaaaacaccttcttttaattctataataagcaactcactttctcctgaatatttccatttagtaatattttctacatcatctataaattttacaaacatttcattactaaaataccattttgtaccattaattgttgttaccgcttgtttatcagtaaattcatctccccaataagctccataaccaggcaaataaaaattaattgattttcctgttctaaaatgataatattctaaattttctagtatttgtttccctgtttcgaggtttggtctcgttataagaattgcgattttatcattatacaatccatgtatttcaatattttcattaatatcttttaccattttttcatatgttaatgcatccctcatcttaaacacctaccttacttttatatttttcttcaaaattaagttttgatcttgtatttacttttttattttattaaaaggacttgattaaataatttttcattttttctttttgaacataattaatctcacaactacatattttacattcattttctaacatagttatatattcgtttatctccatatcatttgcaataaacgctttacttacaacacctctaaccttttttgtcattctaatattacttggtatctcctctaacttaattaataaatacattccaatactattacggtaataatactcattttcatctaaataatttagaactgctcttatatttaatccagttattagaagatttctaagtgttacctttaactttattggaaaaatatcttgtttcataaaaatactatatcttatatagtaaatccaattgataatattattacaacataataattcatcatgcatagataattcatttacaattgctattttcaaatcataatctaaattatcttgacatgacaagtaaacaatgtcatcttgactaataacacacatttttataatccaaatataaaatacatctaatgttttttcatcatatattcttttatataaatcattgtcttctgattcaatataatcaataaatttcaaatatatttgtctattaaagcgatgttttatgttagtactttctattctctttactattatttctatatcatctctcatatttccaagatgtttccataattttcttaacatttctatatcaaatttttcccatccaaatctaaatctataaatcgaatagtatattataatatacgaaaacaagtatttgctatttatttcatttaattgatctaaaacatccccaaaattatattttttattctcggttatttcacaacataatgcttgtccacaaatatcattgatatattcatctttaagaattgcttcaaatacagcaataaattcaatttgtttatctatattatgtgacatacttcttatttcgtctctaattatattttgaatacattctttacaataatacatatacatatcttgttttttgtgtataccatcatataacgtcgatactaatctttgctttatttttacattgtcagctatatcgtataattttaatgttgtatctttccagtcgacgacatcaaatacttctttattttttgaaaatttaattccttcatatttattacatttaattctgttatatttagctaattcagctctcttaaaatttaattcaagtaatttaaaatagaaacaaataatatgtattttattataagtatccaatttaaaaaacttttcatctataatttcctgtattaaatttatttccctcattgcattatataaccatgctatttgattttttgaaacttttccttttttttcgaccccttaataatttagagcgaatttcgctaaagcactcgattatttagagcgcctcttttaatcgttatgctctatagcaaacccaaataatatcgcttttaaatcttcatctaaaatagaagtattagtagctggaccatcaataaaatccatgtgttctgcacgaaattcttcatataaaatttcacaaattacttttaactttccttccttataaacatcttctaaagctttacaagcaattttatttccttctagataacgatcatcgctttgattgactttctcctaaggttaagctctatgaataatcatcctatctaaataacctagtcccgttgtttcaatggtttggacaatactttctttggttacttgacatgtttacggatatctttgcctatacctttttcattaccatatgattgtcctatatcaaaatgatgataacctaactttatattttaatttcaatgtgaataaaatgtgcataatgtgcacaacttgtgaaaatctattttattatatgtgccgtaataatggtatagcttgttgcattaattgttatttttatagcaccattttcaatataccagtttttccctttacgatatatcaaactctttttatctaaaactttattcttacaaaattctacaacatcttcttcaattcctaaatttcttttaattcttgatatacctaaatatgttgtgtgaattttataaatattcattaataattcattcttacccatcttgatgactcgtcctttttaaaataggccattaacattcctaaacttaaataacgatcttttgatatttgtttctttgtattcatcaaaataacaatgacaacaatgaatagaaattctttcatacactcacccaatcttttgttttcttttactaatcattaaggtaatcaaaacaaagcttaaggtaaatcctaaaacaataataccattaataattattggttgtaatgtttctaatttaaaatattctaatgttttaataagttcattattttgtacaaaataatacgttggtaaaatatgagcaatctttaaaacataacttggcataaatgacattggcacaaagcatccacaaagaaacgatgttcctaaagcaacaacattgacaatacctccaatagcttgcttattatgggtaatagttccaattaagaatcctacggccaaactacatattgaaaaaacaaatgaatttaaaatataagcaatcccattcccacttaacataatttctttaaataagataaaactaataatcatataggctaaccatacaataaaagaagcaagacctaaagaagcaaaaacaatccaattatatttacgatatgaaaaactgctcataattgttcttttacgtacaccctcttgatttaaacttgcaagaatcattgtcatacaataaactcccccagcaagtaaggcatagtttaagaaattaaaataaacatttacttgattcaatttagaactatctaaggatgtgttgagttttacttttgttttttggttaatcacttgtttgactttttgatttaaagctttaccttgataatgttctttataaagatttactgtctttatatatttttcaattaacatttgggtaaaagatgcattttcattaccatttgatttatattcaatcgttggatttttatcatttacaagatcatcaccaaagttttcaggaatatacacaacataacttatatcacgataaaacaatgcatcgtctactttttcttgatcattgatgtcaatatcttttaatatcgcttgttcttttaaatacgaaacaaatcctttggttatttcattgttttgatccttatttacaatcaaaatatctggttttgttgcctcataatgattcatattaccagaagttgtattaaataatgtaattgcaagtaagatcactgtataaagaattaagtttccttttaatttatttaagattttaaaaacggtactaaatataatcatattgttccctccttaaagccataaaagaaataaataaacatacaataataaatactcctaaacaacaaatatctctgatatagcgattaaatgtattgtaataatataaagcataaaaaccatcggtaatcaaattattaggattgataagattaacaataggtatatttttatcaataacatattttaaagtaacacccatcatcccagatagaaccgagaaaaacatagaaattgcaatattaattcctgtttttgcttgttcagaaactctaaaaacagaagcaataaatattcccatcgaaatacctgctaaatcaccaactaaagaaagaatgattatataaagccattgactaccaaattctacatttaaaccaaattttaaaaagattaaaagaattgctaaaccaacaaggcttactaaataagaaccaagtgctgaagataagacaagtattccttttttatttggtgaaacagaaactcttttccctttagcggacatattcgccaattgattattaatagctgttaaacctaacatcccaccatacatacaagccatggcaattaaggtataatattcaatttgcatataacttaaatgactacttgatgtgtcttttaaagatacttcttggttattgagcttttgaagaatatcatgtacaatttgttgaacattaaaattatagtttccttgttgtatttcatcttcaatttgtttttttgttaaatcttctatcatcctcttattttgtttaatttcatccataacaaattgcaagattgtttgttccataccattttctttaatcacaatttgtggttcttgtttattaaagagaacatatccttctatttcattatcttctaaaagctgattcgcttcttttttatttacaaaatgaatatgaaataactgatccttattttttttatcagaaagctctttaaaggtttcttgataaattgtttggttttgatattccttattgtcaataactgcaatatcaaaaacttgtaaagcttcgtctttttcaatattttcaaaagccatgtgaaagaaaatacctaaaataataggaaaagcaaacatccaaaaaataagaactttatttttaaaaagtattttaactgtatactttagattatgaataaacatcaatccctcaattcctttcctgttaattttagaaaaacgtcattaagagttggacctacacgttcaatcttttcctcaatatttgcttctttctttaattcatcacttgttccttgagcaatgatctttcctttatctaaaataataatacgatcacaaagtatttctacttcttccatataatgtgttgtataaacaattgtagccccttgatctcttaatttttttataccatctaaaatatgattacgactttgtggatcaactgcaacagttggttcatctaaaaagatcagtttaggcttatgggcaatcccacaggcaatgtttaatcttcgaagtaaacctccggaaagttgtttaggtaagaactttttaaaatcatttaatcctactaagttaattgcatcgtcaacatattgttttctttgttttttatctcgaatatataaaccacaaaaataattgatattatcataaacattcaattcatcaaaaacagctacttcttgaaaaataactcctatctttgcttttaaatcataagaatcaggtttcatctctttaccaaaaaccttaataaatccttcttgatatttaagtaatgataaaatagagttaatagttgtactttttccacaaccattaggtcctaataatcctaaaatttctccttgataaacattaaaggataaatcatcaattgcttttaaatttttatactcttttgtaagatgtgaaacctctattactttttccatcattcttttccttccttattctttttagcaagttgtaccaaaatttcttcttttacatttcctttttttacttcataaagaagcattgaaacatattgatccttcaacaaatctataatttcttcatcattaaattcaacagtttgatgtgctactaaactcgcaatcccattaacatataaccacattcttaaatgaaattgtttagcattttccaaagataatccagtttgttttgaaatggtttcaaatatttgtaaagaagaccctgtcaaatcaatgaaatcaaacatttctttattcatcttactttgaaacattatcttaaaaaattctggttcattactcgcaaatcgaatataattaacaccaatgtctttatatgctggtctatcataattactttttaataacgcttgattaaaaagttttgaaatttcttgaagtacttcattttttatttcatccatattttcataataataaaacaaaggttgtgttgaacaccctaatgcttttgctacctttctagcatttaaagcatcaattccttcctttcttataatctttaaacaagtatctataatattttctttttctattttctttcttgcaggcatagaatttcctttctataacaactgttatatataacttatgttataataatatcttttattctttaaattgtaaaggtataaaaaaagatatttcttttttgaaatatctataaattcaaataagatgcacttattaatttttggacttcattattcttactttctaataattgtttaattggtaaatcttcaatgattctcccctcttttaaaacaataacacgtttacaaaactgttgaactaaagataaatcatgactaataaaaagtatcgaagtatctttattttgaacaaattgttttaataaacaaacaatgtcatcttgaacaatttgatcaagactgcttgttatttcatcgcatataagtaatgtaggttttacaattaaggctcttgcaattgcaatcctttggagttgtccaccacttaattcatgaggatatttatctaaacaagtttcatccatacctacttgataaagcatttttataataagaggtaaagcctcttttttatttaaatgttcatagtaatgataaggttcataaagaaactgtttaatcttcattctaggagaaaaactttcaataggattttgaaaaatcatttggatttctctaatcttatttttttgaacttcaaaaagtatatctcctgtattttgtttttcaatgccacatagaagtttagcaagcgtacttttaccacaaccactttcacctataataccaataacttctcctttttgaacacaaaaatttaaatcatgaagaatttccctttcataacttttaaatacgttttttacttctaataaagccatcttattttcctttcattaccagtctttgcgtatactcatgctttggattgttaaaaagttcatccttaagtccttgttcaatgatatgaccatctttaataacaacaagttgatctccaagatacttagctacctgtatattatgtgtaacaaaaacaaatgttgtttgtttctttaacgataaaattaaatcgaggatttctttttggcaaacaacatctaaattacttgttggttcatccgctaaaatcaattctggttccaaacataatacaagagcaatcatcactctttgtcccattcctccagataattcatagggatatttttgtaaaatagattcatccagtcccatttgttttaaataagagattgcaatttcttttgatttttcttttgtataattaaaatgataatgaagcgtttcataaaaatgatactcaacagtatgaaagtcatcaaaataagttaatggattttgaaaaatcacacctattttcttaccacgatagttgtttaaatcttcattacgtagactttgtcctttaaataaaatatcaccttcaacaagtcgcgcatcctcactcaaaagagaaatagttgctttaagcaatgtagattttccacttccactttgtccaacaatcacagtaatttcatttttaggaattgttaaatttatatgatgaagagtttcatgatttttataagccaaagttaaatttttatattctaaaacactcactttaaatctaaatcctttgtaatcatataatagtcaacaggatgacaaatagctcctttaacctttgaagtagcgacagtatttaatggaacataagaaacataaatatttcccgcatcatctaaaatttgttcacttatttttttagcaagatcttgtctttgattcaaatcataggctgtggaaaattgttgtatcaagtgatctacttcttcatttttataacgcccggtattatttgaacctgttgataaatagcgttgttgtacaaatgtttcagggtcacctgtaggtgcactcgaatcattagcagaacataaatcaaaagttcctgcagctttgatatcattgacattttctacttgattcaattttatttcaataccaatttttttagcttcactttgaagtgattgcgcaataatattagcatcagaagacccatgatccgcactttcatagtaatttaaaacaatcttttgcccgtctttttcacgaataccatcatgattactatcaaggtatcctgcctcgttaagtaaagcatttgctttagctaaatcaaaagtatatccattaaagacatgaccataaggcaaagctgaagaataaagaccttgtgctactttaccaccaataagttttacaatactttcacggtctacactataagataaagcttgtctaataatcttatcgtttaaaaatgttgattcattattcatataaactacatttgtgcgtggacccaatacttcaagaacttgatagtctttattttttctaaaaagttttaaacttgagtaatcaattgtattagcaagatcaacctcttttgattgtaaagctagtacacgtgcatcagaatcggaaacttgggtaaaatggacatgatctaatttggctttaccatcataatagttttcatttctacttgtttctattgttttttctgaaacaaagtcatcaacgacaaatggacctgtacaaattggatgactcgcaatatcttcatcactttgactggcatcatagattgtaaaaagaggttcacaaagattatttaaaagtgctccacttggtttatttaaataaagataaacttcttgtcctttgctttctatatggtttaaatcaaaataatcaaccgcacgcgtattattcttaaaagctctttctaagcattgttgtacatgttttcctgttactttttttccattagaaaaagtaacagaattatttaaagtaaacttccaagttgtatcatcgatttgttcataggattttgcaagagaaggctcaacttcatatttttcatttaattttaaaagtgtttctccaacaccaatacgacttaaaacccaaccatcataattatttgtaggatctaaagaagtagaaatccaaaacatcgccgcattaagtgttttactcgatgaatcattagaagaacatccacataaagacgttaacatcaataaacataataataattttatttttttcataaacaattcctttctaataatgtttaggatctaaataatcccttaaatcttctgataataaattaaataaaagaacacaaacaaataaaacaagacctggaaataccatcatccatggggctacttgcataaattgtttactttcataaagcattgcaccccattcaggatatggtggttgactagcaagtcctaaaaagctaagccctgcaagggagagcatcatattaccaatatctaaaaaggcagtaatcaaaatttgtgataaaatatttggtaaaagataacgtaaaatacgtgttatcaaaggaacacctgacatcttagccacaatcaaataatctttattcttttcttgtttaacaagagctaaagttaatcttgcatacttaggccaccagacaaaagccaaagcaaaaacggtattaaacaatcctgcacctataacacctacaacagcaatcgcaaaaatcgtatcagggaaagcaagtattccattcattaaactatttaaaaaatgttcagctttccctcctaataatccagcaaacaaaccaatactaacacctataataacaattaaaaataacattaaaaatgttaaaccaaaagatgtttttgctccacataaaatacgacttaagatatctcttcctaatttatcagtcccgaataaatgtgataagcttggcccttgtaatgataaattataattaacttttaaaggatcataaggagcaatcaaagaacccaacagcgcaacaaggagtaaacaaaccactaaaataattttaatttttaatttccttttcatgtcttactctccttaattgtgggtttaaaacttgttgtaaaaaatcaacaaaaaaattaacacatacataaattaaagccatataaagagcataagcttggataattggataatctcgatagcgaatcgcttcaatcaccatatttcctaatccttgataagaaaaaatagtttcaataatcgctgttcctccaagtagatgcccaatagacaaaccaagcaaagaagaaagtgtcgttaaaacatgaggtaaaacatgatgaacatatatttctttagaactcatacctcttgcttttaaaccaacgacataatcttgattaagttgttctaacaaagcattttgaatcatacgtgtataagaacaaatcataggaatactcaaacaacacgctggtaaaataagacctttaaaatcttgcccactaataaccggaaataaattcaattttacagaaaacactaaaatcaagatcagagctaaccaaaaattaggaagtgacaatcctaaaaaagttgttccttttaaaatttgatttaaaaaactttttcgatgtgtcgcactataaatacctaagggtatagaaaaacaaataacaatcacaaaagaaaaacctgctagttttaatgtattaggaagtttacttaacatttgcgtatttacatcttgaccataatgataagaataacctagatttccatgaagggcatcttttagccaattgacataacgtaaagcgatattttgatccaatcccattccttgacgagtttgattgagtacttcttcacttggcgtaatgcctttagataaataatacatttcagcactatcactaggagccaaatctatcataaaaaaggtaattaaagttacaaagaaaagaatagatagtaatgataaaaaccttctcattatttaatagcgtgtattaagaactgacggatcaattcttttcctttctttgtttgttcactttttagaatttgactttcaacaaggacaaaaccaatttcatttaataaatccttatcaaattgaggtcttaacacataagaaagcattaaatctttagcaatcgtatcaataatagaaacatcaataccttccatatgttgatgatcactatgtccatttctttgataatcatgatcttgataatgataataatgattgccatcaatatttaacaaatgtcctttatttttaagtacacgataaatttcttgataggcttgtttaggtttttctaaattccatgtcacatttctggtaatgacaaaatcaaaagattcatcatcaaaggtcaattcttgaacatccatttttttaaagtcagtatgaacattattttctttagcgttatgcttagcttcttctaacatttgattactataatctatccctgtcacttgacatccttgttttgaaagtaagatagaaagaaaacccggtccacatcctaaatctaaaacttttaaatctttttttagaggtacgtatgtatgaattaacttcaaccatttttcttggtcatttaaaagttcttcttggttatctaaagaataaccagaagaacgctgattccaataatctgcaattttatttagtttagtggtcataaatactcctttacttaacaaattgatatacttcttgcaaagaacaatgattttctagtgctaattttttagcactttcatattctggataacatcttttttcaccatcaataattacttcttttattaataacttaccaagaggtgtttctatttctttaatatgacgaggtaaaactattctttgttctttacgataacgaataccgattgttgttgtttgtttaaaaatgattttttgtaaaacaactagttgttcttcaagacaaaccacacttaaacgatatgctgggcgattctttttcataaaaatcgatgtataaaaaacatcaagcgctccattttctagaagttgctctaaaacaaatcctaacatttctccactacaatcatcaatattcgtttccatgactataatttcgttttttttttgatttctcctaaagagacttttaaaacattaggaatgactaagtctttagttcctgttccccaacctactttttgaacatccatagcaggcatcattccatatgaactagcaatttcagcaataatcgcagctccagtaggtgttacaagttctgtatcaatatcaatttgacgagagatcacattacttgcggcaaaaatttctgaggttgctggtactggtacagaaatcataccatgtgcacattcaataaagccataaccatcattgacaacactactataaatgacatcaggattgattttacaaagcaagattgctgttccaataatatcaacaatagaatcaatcgctccaacttcatgaaaatgaacattttctaaagtttcattatggactttactttctgctttagcaactcttaaaaagattcttttagcaagctcttttgctttttcatcaatatcactttcatcaatgattttattaacatcaaacaaattacgatgttcatgatgatagtgatgatgatcatgttcatgatgatgtgtatgttcatgttctaaatgaacatctacatacgttcctgtaataccatttttcttttctttagagatatgaagatgataaccatccacatttaatttctttaattcattttccaaataatgtggatcatcaattaattctgacaaagcccctaatgtcatatttccactgattccactactacaatcaaaatataaaactttcactactttttacctcctaaacaattaatggtatgagccatataccctgctccaaaaccattatcaatattaacaacactcacgccacttgcacaactattaagcatggcaagtaatgcagataacccttcaaaattagccccatagccaatcgaagttggcacagcaatcactggtttatcaacaagaccgccaacaacagaagcaagagccccttccattcctgcgcaaacaacaagaacattcgcttcttgaataacatctaaacgatgaaataaacgatgaatgcctgctacacctacatcacttacaagttccacttcatttcctaaaaattgtgctgttaaataagcttcacgagcaactggtaaatcagatgttcctgcacaaacaacgacaatttttcctttattgatttctttcttttcttcatcaatataacaaatatgagagagttcatcataaattatttgcggaaattcttttaagatagcttgacttttttcatcattaacacgtgtaattaaaatagaatgaatatcatgatctaacatattttgaacaatacctataatttgttcctttgtttttcctgcaccatagatgacttcatgattacctgttctttttttgcgatcataatcaatggttgcataatctagtggttgatctaaaagcttttgagcttgttcaagagttaactcattatttttaaatttattaagaatttcgtttgttttcaacgtcatatcctccatgttttattccctctaaatcaagagtaacaaatctaaatcctaagtctttaatcttttgaattaattctttatgatctataatttttgtaaactcttgaggttcaacttccaaacgtgccatatctccatgtactcttaaacgaacatggaacatgcctaaatcgtgaagatatttttcacctttttcaaccatttgaagtttttcaaatgtaagttctgtattataatcaaaacgagatgctaaacaagcatttgatggtttattataagttgaaataccaagttgttttgaataatttctgatttcttgttttgttaattcgttattagctaaaggtgaaatgattcctaattcttcacatgcttttaaacctggtcgatatactttttcatcatctttattttttccatctaatacatattcaaaattatgttctttagctaccacttttactttagacataatactttttttacaatgataacaacgatctttatgattaaaacggaaagcttcaacatctaaagggttaacatctaaaacaacataatttgctccttgtaactgttcaagagctccttcaatatcttctttagacatcatcgcaccacgacataataccggtaatacatgatcttttcctaatgtatcaattgcgacatgaaataaaaagtttgaatcaacacccccgctataagcaattgctacattttcatattttcttaattcagtttgtaataattctaatttattcataaaatcccctaattctttcttacttttttaggcttataagttatagaacaaaaatatcgtatacatttggcaaagttatagtttctactataatcgttacttcatgtatacgatattttctatttatttaatttttcaatcatattaacaaggtcatcaatatattcacttattgatttttgtgcaacacccactatttgagcactacacttcgatactggaattaaaaatttatgagcttcactttcactgattgcacttgccatctttggtgtaatttcaccatacatcgaattagcaaaagcgataccaattgggccaacaacaatagaagcatgcgatacattataaacaactgcattttcaccagttgctataatatcagctcctccttttttgagttgtcctgtcgcaatactatttgtcccgacaccaataataacatattcaggatgtttttcttttaaaacctgaataatattttttccaataccgccaccttgtccatcaactacaacaatttccatgtttcctcctgatatataataaacttcttgtttattttcgatttcttatctttatatcttattcatgaaagtaagcagcaatttcttgcatacgtttactttattgaacatgaaatggacatcgtttatcacaatggtgacaaacaacacaatcacttgcttttaaagctaaatgatgataatgatctttagcaagatcatcacctaagcgtactaaatcataatacttgtttattaatgcaatgtccagtccttttgggcaaggatgacaatgtttacaataaacacattgattatagctttctaatttagggaaagtccccaaaattgaatagtctttttcttctttggatgctttaaagaatgctaaaacatcttgtaaatcttgatcatttcggattcctggcaaaactgttaatacccctggtttatctaaagcatattgaatacattgtgttttagaaagtgcttgatggaatggtgattcacttgcatcaagtaacttgccaccacagaatgctttcataacagaaattcccacaccttctttttcaagacggcgataaagattcatacgttcatcaaattcaccaatcgcataatccccaaaattcaaatcataagcaggattaatactaaacatgaccatatctagtattttcatagccaatactttatgaacaagttttggactatgagatgataaaccaatataatgaattattccttttttctttaaatctaagatataatcaagaacaccattttattgaattgcctttaaatcctcttcttcatcaatacaatgaataaagccaaaatcaatataatctgtttgaagacaatctaattgccattgaattgattcttttatacgttttaaatctgttgtccaaccatattctccagaggtatattccgccccaaaatgaatttgtaagtaaatagtgtctcttcgaccttttaaagcttctccaactgctttaaaaataggtgcatgccctgctgctagatcaacataattaatacctgcatcaaatgcatgatttaacgtttttaacatttcttcatgactggcagcacctaaagaacttgctccaagaccaataatacttatcaattcattaccatgaggtaattttctatattccattatttttcaaaatgaccagcaacatcttttaaatattgaataattgagagatgttgtggacatactccttcacattgaccacattcaacacaatcacttgctttaccaaatgtttttgttaagttattgtagtattctccttgtggtgtccatcctttttcttctaattcttgtaaatccgcgttatataatgagaaatatttaggaatggcgatattcattggacaaccatctacacaataagcacatcctgtacatggtacagtaattgttgaattaatagttgaaacagcttttctaattaaagcatattcttcttcatttaatggtttgaaatcttccatataacctaagttatcttctaattgttccatattagacataccacttaaaaccatcatcacattttcttgacttgctgcaaaacgaatagcccaagaaggaattgacatttctggatgatattctttaaacattttttcaacatcttctggtactttcgcaagtgttccacctttaacaggttccataacaatcacaggtttatgatgttttgtagcaacttcataacattttcttgattgtacaccaacactgtcccaatctaaataattgatttgtaattgtacaaattcaaattctgggtgttcagttaaaactttatctaataattcaggtccgtcatgatatgaaaaaccaattgtttttactaaaccttgtttcttcttttcttgaatccaattaaaacaatctaattcattataaacttcaatactatgggtattgatatcatgtaataaatagtaatcaaaataatcaacacctgtttttgcacgttgttcattaaaaatacgatcacgatcttcttttgttttaataaaccctgaatgtaattttgtagcaagtgtataagcatctcttggataacgtgaaactaatgcctctttagccgcattttcgctattaaatccacaatacatccatgctgtatcaaaatatgtaaaacctctttcaatgaatgtatcaaccatctttttggtttgttcaatatcgatttttgatggatcatttggatccaaagatggtaaacgcattaacccaaaaccaagtttctttttactcatttcctttttcctcctattacttaaattagcctttaagtaagtgctttccttacttctttactattgtatcattctaacaatagaggcgcaaatacctcttttcaataaatgattatgtttaaaaagcatagaaactaatcaatttcaataagttcatattctcttgaaccataaccaagttttgctgctgcttcaatggtatgaacaccattacgtgattcaattctttcaatcaaatgatctcttcctttatcatttgaagcataaacaagatcaatacatgcttgatcgattgcaattggatcagtagaaattaaaataccaatatcatccatacatggatcttctgccactgcacaacaatcacagtcaacagacatatttttcataacattgatataaacaatattatctttaaaatatttatggactgatttagccgcatcggccatcgattctaaaaataaatcatgctctgctgtccaaattttttcaggttcccctgctccatggatatacgcttttccataagatgatgcacaaccaattgaaagttgttttaaagcaccaccataaccacccataggatgtcctttaaaatgagataaaacaatcattccatcatatttaaccatatcttttcccacatagtttttttgaatcacttttccttcaggaatatctaaaaccatatcagggccttcagcatccattaaatcaacattaaaatatttagaccatccatgtttttcaatagtctttaaatgtttttctgttgtatttctagacccttcataagccgtattacattcaacaactgttccatttaacttatcaataattggtctccaaaaatcaggttttaaaaagttttgatttccttcttcccctgaatgaagtttaacagcaatctttcctattaattcttttcctaatacttcataaatttctaaaaccttttcaggtgttattattcttgtaaagtaaacttttgatttcataagtaatcctcctatctctatttcactataaacctaaagtccactttaggagcaagaaatattttcatatttttaaatattcctttaataagttttacttattacatctattaagaaaagattgtttcttcagttatctttctttttaatagtcgttaaaggagaaaggaaaaatgaatacatattttaacgaagtaaagaaaaattttggttttggctgcatgcgacttccaatgaatagtgaagaagtcgattatgaattaacttcaaaaatggttgattactttatccaacaaggatttaattattttgatacagcccatggttatttaggaggaaaaagtgaaattgccttaaaagaatgtttaacttcacgttatcctagaaatcagtatattcttacaaacaaactttcaacacatcatttcaataaacaagaagaaatttttcctttatttgaaagtcaattagaagcttgtggtgttgattattttgatttttatttaatgtatgctcaaagcgatgaaatctatgcaaaatataaaaaattacacgcttatgatgaagcaagtaaattaaaagaagaaggaaaaattaaacactttgaaatttcctttcatgataacgctgatgttttagacatgattctaactgaaaatcctgatattgaagtagttcaaattcaatttaattatgttgattatgaagatcctgccatccaaagaaaggcatgttatgaagtatgtcgtaaacacaataaacctgttattgtaatggaacctgttaaaggtggtaaccttgtaaatcttccaaaagaagaaaaagttgtttatgataaatgaggaacaatgtcttatgcaagttatgctttacgctttgcggttggatttgatggtatgatgatggttttatcgggaatgagtgatatgaatcaaatgaaagataacttaagttttatgaaagattttcaaccattatctttaaaagaacaagaagctgttaaacaagtaacagatttctctatacgctctacgttcagatttcatattaaatttttgcgtcttgtgaatcatttaccagtccttctagctctttttcatttttttcatcttcaacaggtttctttccggtaatatccttatatgcttctttcacaccattcttcacagcccacttaatgacaaaatatagtgctatcaaaataacaattgcggttcctccgcttatgcctaattcattccacataattcaatcctccaaattcaaattcctcagtttcaaaaactggaatttctatttgtgttgccatgtcattacataatctttttctccggtagcctcatctaagccactatgctgaatctcaaattcttctctcttataaaaagatattgcacgtgcgttcttttggtatacgttcaagtacaacttattccttttatcctttgcataattcagcagaattttacctagaccctgcgattgcatttcaccagaaacaaaaatgccctcaacatattcatcatttaaccctagggttaaacttaactactattttttctttgcgatataaaatacataactgtaataatctactactaatctaaaataaagcgattataagctatcctttttcctgtgtttgttttaaagttttcatctatacacttttttatcttttcctgttctttttctttatccataaccgttaaattttcaagcaaatcagcttcccattgtatttgaaaatcaagtccatcaattttagatggagtatgatggttgcctattataaagcatattctatcaatatttttgttatagcctaccttttttaatatttctttcgctacttctggtccttccttttcttgatagacaccatcaatagaaccgtattttttttgtgcttcaaccgcaccaatatcatgtagtatagcaataatactgatgaattctttttcttcctctccgatattttctcctttcattatatcttctgcatttttcaaaactttgagagtatgctctattccaaaaggaatttctttgaatacttctttcatctctataataattttttctttaaacataaattacctccatttataccttataggtgttttagttctatctatccacttttttgttcgccgatacaatcagcatcatgggacggcgcatttcatcctgcatccccggaatatccatcatgtattccggcggctgcggctccacaatatgatttattataaaaccatttgaaagcagtgtatttagatatgtggtcagtgttctatgatattttgtaaccttttctcccaaaaacacagctgtccgtttgccctcataataataattatccaccggaaaatgcagtatttctcctttttcgttataatgccagtcttgtgttccataggcagtaaaaacaggatctatgttttaccttcccaacttctaattttttacatcatatcccaaaagccttgtcgtactcaataactccatttaatttgttttgacttccgttaagattaagtgccataaaactttcatcgtcaacttcaaatggcgcttttattccacactcacttgccggaatatatcctgcctttggatagtatttggaatgtcccaaaacaactgaatattcatatcccaatttatgtgctatactgtgtccttctttcatcaaagataatccgattcccctgttctgataatcgggtaatacagaaagaggggcaagcgcaagaacctcaaccccttgaacaactgcttttgtaaaaagaatatgtcctacaattttttcgtcctcgacagcaacaagagaaagttccggaataaacgatttgctttttcttaacgcagcaactaagttctgttcatttccatctgtatattcagcattttcaaatgcttcttttacaacatgatataccgtatcataatcttctggtctttcttgtcttataatcaaaatagatacctacatagttttaagctttttacaattacaggaaatggcaaatctactatctacctctcaatttttatggctctgacaatgataatatccgggatttctttattaaaatagcattcttcgtaaaatccgtctatgacaaatccggtatcaaaacacagattaaaaatatcctgtaaagaacgatgataataacattgtttttgcggctgtccttcaatcgcaatatcgtaatagctgtgcggcgtcatatatttttctgtaagcgttacaaaacaggggtgctgtgtcgcaaatacaaatactccgttatcctcaagcaatttataaacagaggtaaaaagcggcttaatattggtaatatccatgatcgccatattggagactgcttttgtaaacggcttatttctttttaatgccatcagacttgtttcattcgtggcgtctgctacacaaaactcaatgtgatcagcataccgtttttggcgcttttttgccagttccaccattttctcactataatcaaaagccaaaacagagacagctttttctgcaagatatgcagaataatttccatttccacaggcaatatctaaaatatagtctgttgaatcaggatttagaagctctgttactttggggcggacaacttctctgtgaaaaccatttgattcatcccccattgcacaatcccaaaattcagcgttttgattccaaattgctttactttcttcctttgaatactgcataatatcccctttctgcaaaattacttttcctccttcgccccatggctcctgaaatgcgtgataatgatgttccaatatttcatctgttatcacaaacggcgaattggcatttaagacctgatttcttttatatagtctttttttcaaaagctccttactggctttcatatagacaagttccgtttcagcgcctgctttttggatcagctctttataaaaattccgatttctattttgtttccatagcatggtgtattctttttcaccagtggcttcatccaaaccttcaccttcaataatgaacccttctctttggtaaaaagaaattgctctggcattcttctggtatacatttaattgtaatctttcttttttatccttaatataatccaataaaagcttccctatgccacatgactgcatttcatcagagacaaaaataccttcgatatattcatcatttagtcctacaaatccttgtatcattttatccacttcaaacacatagacttcggattgtaacatcatttctttcactaattcataattacttttccagtattgattggaaataaaataatgtgctttcagatttgtctttaaccatatgtcagcgactctatcgatatctccgttcagcaactttctaatcataacaaaaattctccacaactacatcctttatgcttttctcttttttctattctatcacaagctcaccattaatcatcatttttttgatattttttcttttcccccactgtaaaacagcctctgagcgtttcgttatatagaggggtacacatacagagcaagatccacccatgtttaacggtattgccatttagcctcccgtcaacctatgggttttatcttgatggggatctccccataccctcttcataacagacgtttcacttgtctgttggttccacctaaaggtgttcacagcactatttctaatatcggaagggacagccgatactaaaatacgtggactcccggtgggaggaatagtcacagcgaaaggaggaatatgagaacagaaaacaaagataaagaactaaatcacagacattttataggattacgtcttacagataagacactgaaaggatactgttttatgagctgtaagacggtctatgtcatgatcagcagtttcccttcagaagaagagaagatgatcgttgccgcccatgaattagggcgcatcatcctgcatcgttcccagctgaaaatggctccgatgcaagatgatacactctacaatatgacggataatacagaataccaggccaatctgtttgctgccgatctgctgattgaagatgaggaaatcgaagatatggttcaaaacgaggacctggattatttcggactctgcagttcattgaatgcgactccggaactaatgagctttaaattatacagcctgacaaaacgaggccaggcttatcatatgccgatggagattcagagcaatttcctggcgaaataaagtaaataaagatcctattctatatatcatagtatgaacaggatctttttataatgatttattttctatctaaaattttattaaaccgactaaatactccatagtttgtgtgtttgacttactgtttatatctatcttctcctaaatatttttctagtcattgcaatataaaattgcttatacagtctctcccttaagagtcctggtattctggataatatacagagcgaccgatatgaccatcattatagcgcacaaaccaatcaacagatctgataccatcggtgtaatgtggaaccatataatatgcaccgctgcagttccatataataaaaaggttactatctttccatgccagtctgcaccatgtacttttcctgtctttcgtatcacaagacatccactgactaccatatacagctccttacctgccattattacgattaaaagaagcacatgcggaaaacgagtaaacagacagattaacatcgctgcctgtgtcagcttatcagccaccggatcaagtatttttcctaaattactaatcctatgaaatcttcttgcgatatatccatcagcaagatccgtaagaccagacagcaataagatttcaccagctaacagaggatttttctttacacaataactccatataattaccggaatcagacaaagccgaaaaaaagaaagaagattaggaaccgtaataattctattcaaattttcttcctgattcacttcactctgcatgtacggtcacctcactttcctttttttagacataaaccaataaaatataacacaaaatgctaaagcaaacacaacaccaaaaacattttgaatcactctaagactaaccgctccttgtagtccataactctctgtagcaatggccaaagcaccaaatgtgttaaatactgcctgccagccatattttgcagaaagtcctacaccaattccgccaaggattcctatatatgcatagattgacgaaggaagcagaaaatataatactgtaaaacatataacacctgcaatatttccgacaatccttttacggactctgtagtgcatatcttccataaacggcaaaattacggacatggccgcaataccagcccacattgcacgtggcatattacaaagttctgcaatgcaaaggacaatcggtacgcataaaatctgacatatctgccattttgttctggaagaagtgatatcaaattcttgtatcagatctttcagatttcttttataagttctgtttttatgatttcgataaaatacaaagcaggtaagtgctgcacctaaagccattccggttaatcgcatctgatagctttttcccgtaacatcataaccatatagcagcagatacccaagaaccaatgtagattgattaaacatgaatggattatggcatccgaacagaatcaacacagccagtgccgcaatatttaacagcattcccaataccggtgaaaactgatttgctaaatgcggacatacagtcataattacaaagaacaaagccaaaagcatcgtagattgtccggtgtggatccccagatccgcatttctaaacaccatgagacataataagactactacacctacaatgctgttctcatttccaaataggatgctgaaaatactaacaaagaaaaaacaaaatgccattgtaacagctatcttcaccagatatacccacatatgatataatttttcttttagtgtttcactttttttcaacaggtttttagaacctgcctgatttaactgcaactcctgataaaatgtcatataaatcctcccatcttctaattaatcttaaaactatataatctcatctttctgcattggcagctctataacaaatctgcatccaccatattcacggttttctgctttgattgttcctccggcactatctacaatccgttttacaagtgcaagacctaggccatttccttctgctttatgagatccatctacctgatagaacttgtcaaatattctggattttacatcatcctctattcctggtccttcatcttccagaatgaacttaacagaatcctgttcttgtttcagaaacatcgtaattgtcccctttgaagggctgaacttaatcgcattatccaaaagatttatccagatatgcataaaaagtccttcattcccagtatatttaacttcctccaattctacctgaaaaccaatttctttttctgtccattttgtttccaatgaaagaaatgcctggcggatctgttcatccagacgatattctgtttttttcattggtatattctgattctctaacttggataacagcaaaatattaccaaccaatccggaaagtctttgggtgttaaataagattttttctacatattcctcttgatccggagacagttcttctccctgaagcagcattgtatatccttcaatggcattaatcggggtcttaaactcatgagaaacattagatacaaaatccatctgcagcacctctgttgcacgaagttcttttgtcataacgttaaaactttgataagattctccaacttctgctatacggctgttcgtttccaaatgctgttcaaaatctccctgagaaacttccttcattgctttactaagtctggcaattggttccagtaactttgcgttgataaaggaagtgatcagccctgcaatcaatgtattgaaaatcaaaagccagccaagcacaggcatgctgcccggcagattaagaaaatgattcaaaaaaacaaataataaagcagatatgactgttgaaaatacaagtgccagccagattgcaccagtcagacaggatcggatccgcaatcctttttttttcttttgttccattattttttcaccaccttgtatccaattccacgcattgttacgatttcaaaatccgggttatctttaaaacgctctctgagtcttcctatatgtacctctattgtatgtgggtctgcctccgtctcgtatccccatacttcatccatcaactgttgttttgtaaatgttctgcctggcgaagctgcaagcttatataaaagcaggaattgttttttaggtaaaacaagactttccttatcagttgtaaccgtcattgcatcataatcaaactctgttgaaccgatcacaattttgtgttcactcaatatctgtgcacggcgaagcagtgctccgactcttaaaaccatttcattcacatttaccggttttaccatataatcatcacttcccgaaaaaaatccctgacgcatatcatcaaaggaacctttcgcagtgatcataagcactggtatctgatatcctgctgaacgaagttctgacaccagttcatagccatccataaccggcatcataatatcagaaatgatcagatcaatatattccttatccaatacttctaatgcctgtactccatccgatgcacttttgacttgatatccattcttctcaagcactttttggaatagctggcttaattctttatcatcttctacaatcaatatttgaaacacgttttccttcctccttattagaacagacaccttgcccatccaagcagatgctgtaccaaaaatatttttctctgacgtttctttgttaattcgatcggctctacatgatatggatcattataagttccgccttctaatatctggcgggatactttttcatattccatcatgccctcttccaactgtttattaatatctttactgcgtattacaagcatcagttccgtatccagatatgcacttctcatgtccatattaagggaaccgattacagacagatcatcgtcaatcagaatactttttccgtggtatgaataaccgccttcatattctcagatattaattcctgtacttaagattctatttttgtttttcgcataatcggcagacccaaatggattcccattattcgcaactgaatttgtcatgatagaaaaatctgaaacgttctctgcaatctcctcccatgtattatacatcatatcattacagataatatatggcgtgtggatcttcacacgattttgtgcatttttcatcaattctcctaactgataccacactactggttctttggaacctgtgtgaataggatttgacactaatgtaatcttttctgtctcaaaagtttcgtccgtataatcggtctcgcagattctttccttattctcttcaaaatatttctgatagctgttctgcagctctaaaactgcgttctttacagattttctatttgccagttttttattgttatgaaaataaccactgtcttcctgattccatatgatttcaaaatgctctgacaactggttaactgaattttctttctcaggttcatcgcaaaccactaacacgtctctgtcatagttcttatgtcccggaaaatcactcaggaaataattgtatgtatttcttcccccaagaatatatctctttccatctgcaatcaaatatttatcatgcattctacccatcattttccacgatttcaacggattggccttattatacagtttaatttcaacattctcatgggaagataatccatagaaatacggatttccttccatatcaatccagctctccattccatctactaacggacgaatatgtacacctctgtctgccgcatcatgtagtgctcctaaaatcaattttccactttcatcggattgaaatgcaaaagtagaaagaataatttccttttttgcattcttgatcaaacgcactctttgtaaaagcgcttctggattcttttctatgattactgcccgttctgtattttcactgcattcgttccatgacccattttttgtttcttttttggttgtattggacacttccggctgctttttatatgcaacgcagattccgagcaattcataaaaagccacacataaaaaaattgccagtataacaagaaggtttttacatattttatgctttttcattgtacattacctgattcctttttatttcatacttatacaatacaaagtcaatctcaatttaacctcaacaaggtttgtttttttcatccatgcaaaatcttctttgtacaacagattgttagatatagcaatccagcaaataatctcataaataattgtcccagtcgcaaatatgcacttcgtccggtttgatattggtctgtcacactcattttcgcatgacagaaaccaggagtccactcataaacacgaacaccatgtttaactaatccatgataaaaagaacgagttatattataaatgaattttttatcagggataccaggtgtgataattcttacgtctacccctcgcttagcagccagacataacgcatgcttaaaatggaatcatcttaacctaatacccggataatcaccggtacttttcggtatcccagtttctccgcagcatattttcttctgtggccggatatgatctcatagtatccatccagtaccggtctgacaatcagcaaatttaaaataccatacttctcaatgctttcctgcagaagaaacatttccttatcatcttttatctgaaacgggggctctttgaacggccgaagacgctcaatctcaatttctatgattctttcttcgttttctcctgattgtctgtttggctcagtcatcttaactcctttcctccaggattcaggatactaaaaaatgcctgcctggaatttttataaatagtaaagttccaaacagacattgctgtttgaccattagctgtagctaatagaattgaatactgtttcagctaatttatgtttgcaggtttgggagagattgtttcttttcccgccttttctctgatttacatccccgaataaggggtgacaacggagcggaacccaaatgttgtaagtgcaaaatattgctacgttactcatgaattacgcttgcaccaaaatgatagatacaagcgttttactttattttagttttgacagttcgcttttgcagtctcgctccatggagcaagttgttccagctgttcatctgacattttatcgtttggccgttgtgataagagatatgtcagatatttatagatattcagatcattcgcttttgccatctcaaccattgtatacacaatagcactagcagtggctcctttggactggctgttttcaacttctactaaaggagctgaagcaagtgctgcagtcttcagcttgattgaaacagctaaatccaataaacttaatccatatgattatattgaattcattctggattatttacctcaacaagatctggttgaagatccaaagaaattggattggtgaataccatggagtgaagaaataaaagaagaatttgaaataaaagccgactaaattgatgtgtgtgtgtacaacgcactcacgtgtttcaaaatctttcatatttttctccttccaaagaaaaagagcagatatcaatctactctttgtaatatactgcattgtctaattttttattttgttcagcatcaacatcaatcaattgattgactgctttatacaatgcaattatttcatcttgtaattttttaatatccgcaggatctgacattgtaatatcacttggaactgttaattttgatgggatatcagccaatcaaatcactccatttgaatttgtttttcaatgaattccatgtcatttgtttctttaaccaatcccatgtaatgatatcaactgaaattgtcagtctttctcctgcgcttacattttgctttgataatgcaacattatatattttatatcccattatctcacctcaatttcaaatttatttttaatgacttcatctgcaataacataagtaataatcattttgtaatttccactttcttcgatgcctaataaaaaaataagatcatgctcatcgatttcacattcaatcgtttgcatcaaatcaccatagagatagatttcagcttttgcatttctaatgataaaagtatcttcgggcttttttcttgaatgaacaaaaagacgtatcttccttttttctcctgcatacatttttattaaattctgcatggtagcacctccttgatctcacaaatataatcattacaaagactgatacagctttgataattgatgatttcaagatggaagcataggttagatgtatctacagtaaacattgctgttgccatatatcccacattacctgcatcgtcgtaagcaaataaatccatgatatattcacctgcaacgtttgcaggaactaatgcattccatcttttttcatcgattctatcaaagattacagtaaacgtatcagtttttcctataacctttacaaccataactagtcagttacagatacagcaatgacaaatgtcttaccaccatcaactgggtttggtgtgattgaaacatcagtgattgttggtgcttttgtatctaatgtaacttttctagtaactgtagtagctttaccagcaccatctgttgctacaactgtgattgtatttgaaccttcagttaatgtaactgtagttgagaagttaccagaagcatctactgtaactgcagttccatttactttaacagtaactggtgatgaagttgcatcgtttgtagtacctttaacagtaactgttgcattattagtaactaaaccttcagcaggactagtaacatttaatgttggtggtacagtatcaactttgaatgtaactgatttttgagtagctgcattgccatcattatcagatgcattgaatttaactgtatgtgatccatcgcttaaagctgtggctggagtgtatgaacattcgtatccaccagtagtagctgttttagtgattccagatgtaatttttgaaccactatcaattgtgattccaatagtacttgaatcaactccagaatcatcatcagtaactttccatttaaatgtcggtttattatttgtagttgttgctgatgcagttggataagtaactgtaattgttggtgcaactttttcttttacaactaattttaatttgcttcctaaagttgcatcagttgcatctttagatgtactgtttcctgctgtatcagttgctttaactgttacattgtaatatccaccgctttgattgtaactggattttgtcggagcagtaatcgtagcttcatactttccagtttgtgaatttaaagtaagagtagtaggtactccattaattgttgcttgtactgttttaattgccataatatttttcctttcaatttactttttttaatctttataaaatacggcatttgctagaacaggcatgactttagctgaaactgaatcaatagtcatcgttgtttcattgatcaataatgtagctaatttttcttgaatagttgttccattgtttaccaaagtcggttcaacaggattagcagatgaataagttccatttacaactctaatcttagctacatcatcacccgttccatttccatttttaatgtattctgcaataatgatatcttttcttttttgtcctaaagtaccacttgtaattgtaatgtcctcatagttttcgattcttattaggacaccattagacatcatatacattccatccatgattcttattttattgtctgactgtttagatatcaccatttttgagccgacatttaaaattccattcattccaaaaatagcactaaacaaaagagcatgatcacttgcgtcaacatgccctgtatcagtagtattgattgtaattcccttttgtgacaaattactcacctaccttgtattcaatttttttcattccattttcaattgttaaaatctttctagtgatttctgtttcaatagaaagtcccgtgatatcgtcaacgcttgtaatgatatcacctaattctaattctttttttaatgaagtaacacctaaattgatttcttttgtttccaaatgatttttaaattcttcaatcgctttttctactaaatcatcatcactttcacatgacttataatcatagacatacattgatgaatctatatttcctatttcatcttttgacaagtccgtaatcttttcaaatgcatcatttccatcttcatcgatagaatgcttaatcaaaacgatttttctatcgtgcaagtctcctttgcctaaagcaatcattgtatctactgagttggtagaatcaatacttgaagtgatttctatactgtaatctctgttatatacatcatcgatgacatttttttcaactgcttcaacaacaatatttctatcatcgtaatcataagtatgatagacctttaatctcatatttttttcatcaagcacattgatgatcttatcatagagataatcatatcttgatgaagtagtcatattgatttgagtatccttatcacttactctatagagttttaaaaaagcactatagaaaacattattgaataatatttcaagagctttatggatttctttattatcaatagttaaataatcatcccttgctttataattgctgttatattttggaaatataacaaagcgatgtaagaagtatctccaatttactcccgtgattttgacagttgaatcatctgcgttctgtatctttttagcaaatccaccaaattcactgttaggaatataaatcaagtcatttttttgaatatccatttttttaaaatattcttttgataattcaatatagaaatcattatcatctagtgatgctttctttcctataatgaattcagcttttttaaattttgcaataactggcatttcctttaaatataaatcatcactgcgtgttgatgaatcaattctagcgtgcattatttccattctggagtccctctttcgtaataaagaatcactcttacagagaattgagtcgtttgtttaaatagattcaatccaattggaatcaattcaaaaatacttgattttttatatcgaacatccattacatcgattgctacaccatctgcggtatacttgagaactgttttttcaaatggatcaatttctattctctcttcttttaaaagttccgtattgactgcataaatgttgtcagcaattgaaatccttggatttttacaaggtccatagaaaataatctttgcttttgaagaagcaaaatgtatattgttaacaaatctatctttctttactgctctataggaaaagggataagaaaaaggatatttcataccagatgatgaagtgatatcatcattcatattgaaatcaatcacagtttcctttatccattttgaacagaatctaacagtataggttagcatttctaaattgctgtacttagcaaaataattaggtttaggcttaatgaaataacaataagcatagtaatcatttatataaagcttacctgctttaacaatctcacaatcatatccaaaaatataatcaagatcattaatcaattcttctttgttttttctatatacttggatttcaatgtccttttcagttccattaaaataaaagctgtctatatcgttacgattgtcaagctgataagaagtagaattgaaactaatttcactttcaaatagtgtttcgatatttttgataagataaggagcagtatttaaatctactgttcctttgttaccaacatatctaatatcatattttttcatcagtacacctcacttcttatcaactttcctaattcacgtctatctagtttaattgataaccctgctctaataagagcatttacaaagacatctgcaagtctttgataatcaatcaattcttgcttattagaaccaccggaatctgttaatggagttactcttgtttgagtccccatttgagttaacaactctgcacctcgttctcctacgatagcacttccttttaataagttaccaccagtagcaagcgccggaatctttcctaaatgacttaagctcaatccaaagctcttaccaccgagtgcaggaacccaatcgggaatatcaaaatgaagcgtattcaatccatcaatcattttattgattccgctgattgctccattcaagcatcctataactgcattgattggtgccctacatacgtttcttatcgtattgaaaatcgcaccaaagatatcaatgacaccttcccatgcttttctccaatcccatgtaaatactccagtaatgaaatatatcaatcctcgaatagcttgaattaccgcatcgattattccagatacacttgataaaaatgaacctaacaatcctgctgaacttgtcacaaaaccaactatgactgtcaaaagtccttgaatcaatggaataacaattatttctatcaatgaaacaattgcattgataataggactaattccatcgaacagccatgaaatcaatgtaacgatgttcgctatgacaatttgaaaattttcccataagggaactaatgcctcttgccagattgcaagaagtgcaattttcaatgtatcaaatatcggttgaacaacgaccgctagattttgtagtatagacatgacttgatttacaatatcgacaactgcatttctaaatccctcgtttgtattccacaagttaacaagtgcagctactattgctacaacaagtgcaatgattgcaagtagtggtccgctcaatgcactgactactgtacctattgctcctgctgattcagatgctccaaacaatgccaatttgaattttccaaacaaggatatcgcggttgatattggtcctgcaagcgttccaataacaaccaataatggtccaattgcagctacaacagttccaatgattacaatgatattagttatttcatcatccaagccattaagccaagaaaacaaatcagtaattgcttctacaatatcacgtaatgctggttctaatacttctgatactttgattcctacaccttctaatgcagaagatagcgtagtcaaatcaccttgcaagttatcttgcatcgtatcagccatatctttagcagcaccatctgcattcttgatattttcatataaagaattgaaatcactgtcacttgcattgatgattgcaagcattccagacatcgattcttttccaaaaattgtacttgcggcggccgactgctgtgcactgcttaatttcccaaatttagttcttaattcttctaggattgtaatcaatggttttactgacccattcgtatcagtaattgagatgcctaattttttcatctgctctttcattgagtcagttggacttgctaaattagcaatagctgttttcaaagcagtacctgcttgtgaacccttgataccagcatttgccatcaaaccaactgcaagagcagtatcttcaacgctgaatcctaatgttcctgcaagaggagcaacatatttaaatgtttctcccatcaaagaaacattcgtattcgcactcgatgatgttttagcaagaacatcggcaaagtgtgatgaatcttccgctttcaatccaaaggcagttagtgcatccgttacgatatcacttgtatttgctagactttcaccagaagctgcggcaaggtttaagataccgggcaatccatctatcatctgttgcgtgttccatcctgccattgccatataattcatagcttcggcagcttcacttgcactaaatttagtggatgcccccatttcctttgctttatcttttaaagcttctaaatcttttccagttgctccagaaacagcagatacttcactcattcctgctgaaaagtcactacctacttttacagctgcaacttctaatccagcaataggagcagtaacatttttagttaatccatttcctatttcttttgtcttattttcaaaagcttcaacctttttagcatactcttctatttgagcttgaccactttctaaagcagcgtttacttcataaagttgtttcttatatttattcaaacttgactctgcattattcaattgttgctttttattggcaatagccttttcatctttgttttctgcattttcaagttcttctagttgactttttaatgcataaactcttgatgaataagtttctgtttgctttgtcaaatatgactgtgtatcttttagctttgtcaatgatgatgttgatttatcccattgacttttagccaaagaaaaagcactgtagttttccctagtcagtgcgttgattgtttttaatgattttgtaaaatcagctgttccatcagccttgaacacaagaccgactctttttagatcatcagccatgttctattttactcctttcgaattcaacatgagtttctaataattcatcaaaagtaattggactcatgtgccaaaaatcatcttctgataaattaagctgtgtcaaagcaagataaagattcatcgtgaaatctatttcttgctcttcacaaaattcttcatattgcctttttttttgaggatttccattttattttcaaactgcttgattatatttacaatcgcatctggttcaattgggcataatgccaatgcatcttcaaattcaaccttttcacgattagaacgtaaaattacataaatcatttttgcagccatatagaattgtttatcttctattttttcatgcagttttttagcagcaacagatgatttatcatccatcttttcatatttatcagtcattctttttaaagcttttgtttctttatcaagattattgtttttaatcaaataaagagttaaaaagctgacttgaatttctatgaccctgccatccgttaacttgatgtcttgtttatccatcactaatcacctgcaattactttttttagatcttcatctgatgtgataacttgattaaagaatttttcttctgttaatccagttgcagtttttacagcagtatcaaattcaacagcaatttgtcccttatcgttaaatggataagctctaattgtaactgtatcattttgttcgctgaaagattcttcttttgtatttgtatcatcagtatcagaagttaatttacattttggataccatctgaatttttttctattttgacgatagaaaacagtttgaccaaaagcaaaaaatggacgttcgcttgaaccaccttttaaaatcaatccactttctgtaatttcatctcctcgcatttttgcaaggtcagtaggatcaaatgcaaccacttctacttcactatcgacggatgaagtatcagaaactgtatcataatctcttgcagatgcatataccggtgtcgtatctccgttttcagtacgtttgatacttttaacaacatttgaaacagtaacctcctcttcgtatttaccagaaaaaatttgagaatctacttcatttgttgtagcaaaacaatatctcaatccaccgaccgattctttaatcgatggtcttttttctttttgtgacatctttctacctcctaatttttataaattatttctttttttaaaactttctatatatctttttgaatttctattccataaaggtactaaatgaggatgactacttttcatcttgatagttcctctttcgaccataggaccataatatttcccccaacctatctctatttcttttgctttttttctataagaaaaagtgaatatcaaatgtgtatatccacttttagaaatctttgatttaggactgggcagtttcaataagtctttgacaaaatcttgtgctatcttttcttcctcttccactacattatcagatactttcgcatattcttctaatgcttttgaaaaatctagaagtccatcaaattcacttgtatcactcatcattatcaacttctaattctaccgaaaagtaagaatgataataatttctatctttgtttttttcttctacatattcatgaaagatcgtaggatgcaatcctaattttcgcatagtgtctcttaattcaagtaatttataatgtctaggtgttctagaaaagaatgatacttgaatcgtttcaatagtgatatagacatcatcgcttgctagtttgtcatcccatgcaatttcccaaaaaacgattctaggatatttacttgcattattgacagagctttgaccttcgttgattggaatatctaactcacttaatgcattgacaaaatccgttttcttcatcatattctccttcccaatttacaagagttatatcagattgtttaaatccattattatcaacaaagtgataaatgttataaaccttataaaaatgttcatcaattttcaaaacactcattgaatcaataaatcctttgacgtatggaactctaatttttagttgaatatcaatatcgtgagagtctaaatcacttcttaatctgtctgatactcctaattcttgatatgtcatagaaatatcttttgattgcaacgaagtatttgctagaacgctatcatcttctatgatttcaaaaacttcaaaaagcccatcattataaatgggcatatgaattctactagttttcttcatcatttttaatcaaaggaactttgtccatttgccacgacaaaatctcatcactgtaattttcaaagaattcatctgttctactattatatgcgtaaagcacatagttttttaatagcgctctggcagtcaaatcttcatcataatcaatagttccaactagttttgttaagcgataatttccctcacggatattatttctaatagatgaatcttcataataaaaaggaataaatttctcttttctaatttcatctatcaagttatcaataacttttttatccattttttcaattattcagttgcttgtgtttgtgcatttgtttggaaatattttggaacatattcaactaattttgttggatcaaagtagaaacatacatcatcatctactgctctaccatttccataagcttttgcaataatgacatctgcatcatccattgcttttgtttgatcatattctttaacttcaattgctgataatcccattgtgtaataatcaggcttatcaataaataatcctgcttgtccttgagaacaatttgcagttggaattgttctaattttatctttagatacttgcacatatcctccagctagtgcttgtacatataatgcaggatctacataagcagcttcatcatttggattacatactaacgctaatgatgaaattgctcttttcccaccatgcgataattgtgtttttacgggagctaaacctttaggtgtaaattcagttaattttgaatttttagttttcattttatgttctccatttgtttcgacttcatttatttttcggaaaacaccgataggttgttcaactccagttcctaataagaatgcatattctaaaccatcattcattgtttcagctaaaattgctgtaaagtatttatcaacaaatggatttgataaatctctaattgctttaggaagaactaaatatgctgtgatttttcctaattcgatatttaatgcttcaaatgcaacgcttaattcacctttaacagcatcagtcaattttccccaagcataagttccagttttggatgctgataaccatttttttacgtcagccggagcaaaagatactaatgataataaatcacttgctttttttacatcagctaaagtgttatcaatgattgttgttgggatcaagtcgatttgttttccatcgatagcttgtctgacatttgtttttaaagcatcatagaatttattttcttcatcgcttaattgtcttaatcctaatttattgaagttttgagcttttgcatttgcatttgctgattcttttaagatttgttcaatcaaatccttattagcagcttcattgattaattctactgcttctaaaattgcttgagatttatcttctgctttttctaaaatctcttttgctttttctaatgtagctttatctactttattaaatttcatttttttctctttcctttctatttttttgtattaaaaaaagcattccaacctgttaatggctcttcattttttgccttttcaagtttcaatgcttcttttacctcattcaattctttttctaaatccttattcaacataacttgatgattcaagtacatttcattgattgattgctgtgcatcatcatcttctttgattgatgtagcaaatcccatttctaaagcttcttctgcagtaatccatgtttcattgtccatcaattcaactatttcatctcttgaaagatttgaatatttttcataaataacaatcgatggttctgtgattttatctagatcatctgcttgctttcttaaatctttagcattaccgcttgcccaagtccacgcatgatgaatcatcagcaatgaacctttatgcatgactctttcctttcctgccataaagatgacacttgcaatcgaacatgcaaaagaatcacatacagtagttacatttcctttgaattctttaatcatattatgaattgcaagaccttcacttacagacccaccatatgaattgatatgaactgttaaattgtctgtatcgacatcattcaattcttttaaaaagtcataggcacctacatcactttcatcccacttgtatgaggtgatgtctccataaatataaagatctgtcatttcttcatttgattttttgaattcatagaacttttcatgtcctttcttcattattcatcaccccctttcgtattttcatccatgcctgtagcatagtttttagtaaatcttctagcatttgcccaatcttcatcgattggtggtttaccacgtaattttaaaatatcgttgtgagaccagccattagaatataatttatcaagattagatgcttgctcgatgacatcaatatgcttgattgcatctgtattgattaaaatcctatctcctctttcccattcgagctgagaaagccaacatccattcatcccatcatttaactcttgaataattggatcagcagcatacgtaataaattcattgttagcatcacttttttcagtaacttctccataaaagacactttttggaattcctaaagcaatcgctacatttgtgaacacttcatcttttaatgctttgacatcactagcagtcatcgttgacttgctgtcaatcgcacttatgtcgagtccatttctagaaaagataactcttatatcatcacttgaaaggtcctttctaattttttctgtatactcattttcagttattggttgtcgggttttttcactatacacttgcatattccccggcatttgaattttaaattttgaaagttttgactttactccttttatagcagcactccaagcaatcgcattttcttgattgatttcatttagataagctaacaacttttcatttttatacttaaataagactgcatcatttgatgtaaatatcctatccagtttataagttctattcccgcttctaataaccacatttgaaaatgttctaggatatagaacatcatccgactgcacaaagctttcagctctataaatatttccatcactcatttgtacaactaaacatccatcactacttgtacacattttcataacaacttgtttccaaaaatcagtagcaaactcatttgggttaggtctaacatttaaacaatattcagttttgattgcatcgctatccgttgagtagacatcaataggacatttcgatatcaaatcagcaatcttgttaaacccaatttctaatgccaactgcgaaagtctatttttttcagccatcatatcgatatagtaatcaactaattgaccatctttattaaacaatttctttacaaattgaaacattgattcacctcctcattttttctatatataaataatcgtttcatctaacatatcttctgcagaaatactacatacaaaagccataaaaccatcattttttcttagttttggttctatttttccatatgatttatttccatacttgtccattttcacagcggtattattggtataccatcgcattatggcactgtttccaaagttaatatttccatctacaaatgctttttcgattagaggagctacatatgtattgattgcaccttgatttctaatcattcttacaagtccagctggatttttcttatcttctataataatcccttttcgttcaaatacttctctaaacaacttaaatctatacgtatccatgatgattttaaccacattgtatttttgcatttgttcaatacaccattcgacaatcgcatttatacttaaactttctgagttgactatttcataatcattgaatccctctaatcctatattgttttctataggaaatttaattgattcaaaaaatgggctgttcctgcaaatccatgtcttttgtctccaaacgtaaacaccatctattttaaaaagcaaaccagcagatgcaaaatctcggatatctgcatagtcaattcctataatgcaaggatgatagtttatatcatctggtatcgctctttctatcttattttctacatcactataacaagctcttaaaatatcttcccatttagctactgttatttcttcgtttcttgcaggtagattcattcttttagttaaaaattctgtcatcatcgatggtaatttttgtgcttctttaaaatctcttaaaatttgtatttttaaatctggaagaaattccatcgatggatttgctaagacaaaatatttaggatcattagcttgctcttttgagttgattttacaaaaaaaaggaaaataacctaaatcattttctcctgtttttaatatatcgttgcataattgaattaaatcatctaaaggaccttctcgaacgttcccatttgtagtaataataaattttcttgcgtgctttatttttcctaattgagaattaaacacttttatctgatcataattttcatatccatgatattcattaaaaagaatagctcccgatttcttaccatccttcgtcttagcattagaagtattataacgcaactcagctcgtgtcttcctatttttgataagctcttttgttttatagaatttacttctaaatttattccattgggcatctaacatttcgtaaacaacattgaagctatcttttgcttgctgttcattatttgcgatgatatcaatgtgataatttttaattccgtataatggtgtctgaaaaaaattcatcagtggcataataaaaccatctttcccatttccacgtcccatcaatataatgattgttgtgaaaagtgggacatcatcgacatacataaatacaaaagcatatatgaatttttgataaggaaacaaaggataatagttattttcgcaaaattttaaacaattttgatatgttttttcatcaaaaaaaacatcatttctagccaatgtaggcataacaatgttctttatcagtaattttctttctttgtttatcttatctggattcttttttacatagtcgatataatcattgatttcttgacattcaatcaataataatcatcatccgaattatcagaggtgttgattggattttgcaaacctaattcatcaaggattttcaacatagttgttgttattttcattaggttttgcacagattcattaggcttttcgcttttaaaaccatttccggatgtaactgtatatcgcaatcctttttttttgatgtcctgttgacattttcttttaagatcataatatttcatatagtcttcaatcaaatcaagatagtaattttgatacttcccttgtgcttctagctgttcaagcaagtcatccttgatttctttttttgtcataacaacacccctttcattattttttctaatcaaccacccgttatcacgcacgcgcgaatatttctgaaaagttaggaccacatgcccgttctccgtgtttcaaattcgcatgagaatttgacggggggtatactgaattaccacatttctttagtcaatttctttttatacttgaattttttccaagttccatctctaccttcaactatctcatgacattcaaagcaaagacttaccaggttatcatcatccaatgctaattcaaaacaatctttcatcggtatgatgtgatgtacatactttgcacgtttgattttaattctctttattggttttgattcaacaacataattacccttgcatctttgacattcataatgatctctattaagtatctctatgcgtttatctttccattcacgtgatacatagaatgcatgaacatcaccatcattgactagctgctttacttcttctagcgttcttcttttcttcatccactttattgtaatagatattcttatatcctttgtcttttagttcctttaatgattggtttatgttttctggaaacatatccaattgataaaagactccattatattcataaccataaatataatctttattttgtgctttaacttttgtttctttgatcagccattcatcagttactattttcttttgaattccatgatacataatatctacctcctttttttgtaaagaaaaagagatagacataatctatctcttcgctttcaagacaaagcattgatgttgttttcatttaaaccacattaccataataacacatttttccttaaaaaaattatcaaataattatcaattttctttttcagcttttaaaatcttttctacatccctattttttaaagctaaaacctcatctaaaatatcaaatgcttcatcagcaattctataaaaagttgcttgtgaatatccttttttaacagcttcatttattctttcaatactgttattaggatagttagaatatattataattacttccctttgcttttcgtttagtaatttagtaatagactcttctaaaaagtcgacaacagtatcatacatttttatatgttcgtcatatttatcaagattttcaataagcttattatatttttcataaattgtcttgtgtgaacctcctggtaattcatttgaatatgatatagcttgtgtagtattttccaactctttttttgtttcttttaatagaattgcagttgctttccatcttttccaattcaacacttgatatttagattctttcatatgctactcctttcacttctaattgatgtcatcattttcgatatactcaatagtcctatttcctttgttatcaacaaagaaagcaaattcaccagaaaacttatcattcatttctaatacatgattttttaatgcattagatttcttttttagctttttatttaatttattagctttggttgtatcaaacgttccaaagttatctctaacttgttttcttgctttatcaagctcttcaactagaagataatactttctatcttgaatggaagcacgatatatttttttgcatgaaggacaatagaaataaattagatcaaacttcaatccttttacttccatcttttctttcattatcgattcttcctttattacaaattcatgattgcatttatcacatgtaacagatgcatccatgatttctttcatttgttctttaatatccatagacttacctcttataaattatattgtatcttcattgacatctttacttcttgaatatttgcatcatttaaatgacacattttctctttcagccatttttttggaatggttgttatctgctctggtaagatataattttttctacctcgcaacattatacttctatgttgtggtaaattatcctttttagtagtaactggaatgattgtcactaaatcacaaaaagaattattaaaatcattacttacaataatacatggtctcaacccactttgcttgtgctgataatatcctgtgcatttgttatttaaatccacccagaaaacatcacaatagtgatatttatttgctactgatccacatatagaatacatttctattgctcctttatgattggaatttggattggataatatctattttcttcaaaattacaccattcacagttcgaatctctattgctcattggatatctaataatcatcatttgattatcaacagtaaattcttcaatataaatacaacatttattttttacatcataaacccacatattttcatgaagttcttcaaacttaagagattgaggactgaaatgttcttcaattaatctatcaaaagtatcaaatgcagataacggaatattaattccaccatacattttgatattattgagagattgcaaacaatcatctttatttattattttcatcttcaactctccaatcaatcgcttgtccgcaatttacacagtagtcatcttttgccattacaagttttttacatttggagcaaaaccaaaactcatgaccataaagttcattgattttgctttgtacttcttcatggattggctttgctggtattgctttttctactaattcttttaacggagcatatgaattacaattttcattaaatccattacatatacaataacgaacttgattacagtcgctacacattatctttaatgcttcttgatatttattcatcttccatttctcctctcaactggaattggataaccatcaggcaatgacttgattaattttttaaatttattaattgcatttttttgtaaaactacataagagttgttttcacaactattaagttcttctaattgtttattaaggctttctagaatatcacttctaaattgaggtgttagtggcttaatcatctaaccaccccaattgttcataatttttcttttttcttggcttgtatgtcttatcaaaattaaagacatctatttcattaaattcaaaatctttgcaattatttgttgatctaattgtgctatctctcattactttctttttcatgccacaataagcaccatcaccataagtacagttagcacaatatctacaatactgtttcatctaaccaccccaattccttacattgctgatttattgcttttaaaagttccatatcaacttccataactatatctgaacacatacagtaaaaagttttattttgcaaatcaaattcaacttccctaactttgacatcattgatgtgcatgaaataaatgatttcacgatcatcatgacatatttcttcaaatcctaatttttcaaacatttcttgtgctgtcatgatcaatacccattcttaagtcgttcgtaattgattttgtttttgttaagatattcttgatatatttcatcgaatgaaaatcctaacatttcagttaaatctaaaagatcatttagcttttcaaaattacttgctacagcaccgataaagttgcctaacacacctgttacacccattccaaatcgaatgatataatagccatactctttaataataaaatctatatcattatcactttggtaaagttcccatgtcattacgaaatgataaacatcaaccaattcttctaatactctttgacgattgacaggtggttgtgtttttttccaccagcaccaagctcctttacattcatgagttaactcccctaattcgtcgataatagctaactctaatttttcttctgtcatgctatcttcaccgaattcttttaaaatgttttcattcaaatctttttgcattgtaaacatttctcttaattttcctttaatatttaaattttccattttaataatctcctttaatttctttccaatctagtacttgtccacattttgtacaatagttttgtctttctagtaaaaatgaattacaagaaggacacactaacgctgttcttccaacaattgaaccatctggagtaatactatcggcaaaaactgttaatggtttttttggtatagctttttctatagctttgcatattatttcatcatcacccatataatcaaacatctaaccacctcataactatttaatatttaataattttctatatacagtaattgcttcttttaaagtcatatcatcacttacattttgaaaatagcctttatttttcataattgatagttcccatacatttgaaaatatttcattttcttctaatacgttataggctattgtttccagtaaatctaattcaaatttcatattttttctccttacatcgcctatataactatgacgtataacctattattatacgacatcatttaaacctctctaaacccttatgtagtaagggtttcaagagattttacttttaaaaaactttttactgtttttttaatgaatttttcataattgattgtgatatttcattactagtcatatgatcatacttttcatcaactagcttatctgatatcttctcttgtatttgtttagtaatatctatatcttgtgtttttttagaatcgtctttttttaattccaatttgatttcccatttttctggtacaatatctttattaaaaaagctgcacataaagttgtataaacaccctttacattcatcatgatttttacaaaagttcttgatagttgataatgtttcatattctgcaatgttatctactataatcatcttcttcccctcctagagaaataatttattgattatcaaagccaatagaacacataataataatttcatttttttacttcctctaatcttttcttttctctcttagcttttaaaattttacagctttcaactgcttcatttgtaatgccgaacatttctttcaactgaaacagcatgatttctacgtcacatatttcttcaattaaattatttttacattcttccttgtttggataacgtaaacacttattgattgcttgaatgagttcagcacactcttccttcgcgtgttgcataatattttctggctttttttccagttacttctcctatcaatatgccatccttttcatcatcttctactaggatgtatttttctctaaaaataccttgattatttaaaaagctaactaactgatattctttaaaacccaattcttttaacaattctttttttgaaatctttccatatgactttgtaatatcatctttatctaacatcagataattcatttctttttacctttgctagaaaattcattatagagttgattcaataaaagaaattcaatgcagcctagacacaatagaatagctagaatattagcaactctacccgtcaataaaagcaaacatccaaaaaacataactgctacaatcaatgctttcatcatgatctttttcttatttgtcattttttagctcctttcttaataaaaatagttcttgtcttaaacgtttattatcttctctatattccactgccatctcacgatatcgcaatctttcattgtcacattgcttatatctagtttcttgataatcaagttcgattttttgatgattgaacaattctttttgacgttctacttcatttttgagttttttattttcatacactaaaggtaagtgtttttcctttgtccaattgattaagaaatcttctagcttttctctttttgttggctctttttctatttcctttttaatatcatttgtcaaaataaactcacctgctcatatccacgtctctttttatcttctttccatgtataccgcatctggaaagactttttttacatattcttctgcaggttctagattataatgattcattactttatcttgatgtttataaagaatgttatttatccagatagctttcataattcaaataatgtaggttgatttaaagagcgctctaagtttttaataaaattcaatcccgttttaaaataactttctttgatttcacaacctattccatttctatttaatttaactgctgaataaggaactgacataactccgccaaatggatcaaatactgtttctttttcatttgaataccatttaataagatgttcaatcaaatcaagttgaagtggtgtcatgtgcttttcatctttttcttccttggcaattttagtgtttaagacatttgttcttgatactttaggtgattctttaccaattccccagcaaggactagctaaacgtgtccattgatgaaactcatcatcgatattttcgtgtattacatgaacccattcatcttctcgctcatgtttttgcatcaatataacgtaatccggcattcccgtacgtgtgatttcagcaaacttcttataagagttccacaagatagatgctgatttagttctagtagcttcaatttgaggatccttaaatactgtgatttctccgtgataagtccatccatgcttttgaaaagctttgatggtcattcctctaaaatctatcaagcccattgctccatctcttcctttgaaagttggaatctgcatcacgtgtaaagcaataatgcgccccggtctcgttattctataaagttctgggatcaagtaatccatttgttggaagaattcatttaaatcttttacattgctaaaatctctaggatcatcactgtaagtataaaggttagcaaatggaatcgatgtgattgttaaatcgatacaatcatctggcaactgtctacatacatttacgcaatcatcattgtataatttgtaactcatagaaagttcggtatttcaatcttctgtagttgaaacacctcattcacctcttttccttcaaaatttaataattgtatttcttgaactgacatatccatttgatttttgagattatgttgcagttctttctttttatttaccgtttctaaaatatgcatttcagttgttcctaatacgatataagaatagacatcttgtttttgtccaaatctataaattcttctcaatgcctgatgataattttcataagaataagtcaatccacaaaagataacattatgacatttttggaagttcattccgtaaccaaagattttaggttttgagatcaaaactcttatttttccatttttgaaatttaaagcgcatctttcttttctttgtggtttatcactacctctaacctcaactgcttctggaatgtatttttttaatagatccgcttctaaatttgtatcacaccagattaaatactgttcattatctttcattgctatttcagcacattttttagctctcacatcagctgttctattcttttctttgtgaaaagatgtagctgatgttcctatttctctaaataatccatgttcaaaatcatcatcgatgacatcaatatcaatcatgatgttttgttcaatcaatttaggaagcacataataatccgcttcatatcccaaatccttaggactttctatattgatcgaccaattacagcaccatttataaaaatcctttgtagcgtgtccttttaaacgatatgaaccagttttcatatcattgataaaataagttgccagtgcctgtgcagttgtcatgattcctagaaaatccgcatgattcaataattccattaaatcatttggtgctggagttgctgtacaacaaagacgatattttgtatttttaaaagcatttgtcagttgtactcttgttttgcctgtgaagttttttaaaacacttgattcatctaagacgataccagcaaataaatttgtatcaatattatccaattgctcataatttgtaatataaagtccgttatcaatcgaaaaatcatctctcaatacttttacttcataacctagcagtggagcttcctcatatgcggtttgaactgttacacctaaaggggcgaggataagaacaggcatattcgtttctttgtttaccttatgtgcccattctaattgctgcaatgtttttcccattccacatgcttcaaaaagtgcaaatcttttctttttgagtgcttttttaacaatagctttttgataatcgaataaaacaggatttagatcatccaattcaatatcaattccatctgtttcttttatcttcttttttgattccaaaaattcttgatagttcataatgcacctcctaaagtgtatttgtaagcatagagttatctattattcttttatgacaccaatcattgataaaagacatttcaactgtggttggttctttattgtcatatcctctagcctgcaaaagaatcttattaactggatctatttcaacagtaaccagtgatttttctttttcttcctgttttctaacaaagaatactgcagattgatgtgccgcaattttaggaatgtaatttctaacacaatgattcatttggcttgattcattcactaattcctcaacagttcttgcagctctaataacgtaatcataattttcataattgtacggtcttatcatgttttcaaaatcaatgatttcctgctcatactctttgttgtcaaggacttcaagattattaaacatcttgtcatgttctttttttaaatcctttggaaacagtttgcttttatctattttcacatggagtttttcaagaaaatcaatgtaatccagccaaaaagaaaagtttcttttttgtttttttagatattgaattgtttttttgtcatttgcataaagatttttgctttttctatatccaactttcaatgcatctcttgcatactctatatcaaaagtatctaaatcaaccatcatctgcatttcatacttatcagggttgatttttgaccatactctaaaaaattttttattttcttttaaaaactttcttacatcattgacatcgtttctttccatataccgcatgatatgtctaaagtattttgtcattcccatcttgtaaatcatttctatttcaggaaatatgtcataaataaaaatgtaattttctaaataccatctttttgatatttctaaaatatttgcatacctatattttgatttttctatacatttttttacattgcttccaataaagtaacctgcttttgggaccttttctttccatatataggcatctgttaattctttccatcgatctttttcattatatttaaatgaaacaacatagttattgcagttagcgtatcttttaaccgataaattcttgtctaaattccatcgaaatacttctaaaacttcatgattgatttttaaaagctttttattgtacatttttttaaatgaaaacgttcttaaaataagctcatttcttttattcaaggttgtaattgttaaaaagcagcaataatccattaaatttctattctttctataaacttgagactttgatttacaaacaggacatttcttatactcatttattttgatttttttatcctggtgcgttgaattacagttcgtacagaaatatgtatgatcatctaatctaatcagcttattccatttatctctttttgcctgtttatttccttctttgatcagataatcaatatttctatactcaggtatcttaatcagttcatcaacgacttctttttttgttactttcatagatcaaaacctagttgcatgtcatttacctttgattttttctttttagctgttctctttggctttgtttcctgtttcatcttttcaatttcttgtttatacgcatcacattgcatttgtaaaagctgcattttactgttttctttttcatcatcatttacattactaggatgcattagcatgatgttttccattttctttttaattgcatccatatcaatgttatcttcatcaagataatgaattactattccatataattcttcatctggaccaccaacacatgtcatacgttgattgctttttccttccaaatacttcacatagagctcatgactgataaaaagcatcatgtcatcaatgttcttattttctttttctagcaagctacttatatcatttctcgataaaagatagtctttaatcattacaatcattgaatcattgctattttctagttgttgtttgaaactcatctatgcccctccttatttttttgtccaattcatctctatattttttttgaatgacgaacaattcatcttcagttatctccttgactattcttaatctatttgttgaagctcttgtatctaatcgatcatcagtagaaagcaatccaagtgcttctacaatgcaatagcggtttccttggtttttaggataatattgtaagactccaaatggctccatgcaaaaatgcataccgtttttagcagttttaggatccccttcggtttcgtaggtcttaccaacctcaaactgcatatttctacatctaagatttgtatcaaatcctttatatccatatactcccattatttcaccttcttttgatgcattattaagattgccctatgtgatacttcgtttattcttgtaagtctatagcttatcaatctatatttatcagcataattctttctaaatatttctttcatgtcctcataatcgatgcattcaaagatggctcttttgtatgttttttgcatatttgacctcctcaaacacctatatagccatgacgtataacctataattatacgacatcacttaaacctctctaaacccttatgtagcaagggtttcaagagattttgctatcaaaaaactttttctattttttcttctacttttttcatttcctgtatgatttcttctattttttcattagaatgcataaacaatggattgagtattacttttgcatactcacgtaggataagattactgttttcatccactcctaaatgcaaagctacttctttgatatagccatcatttctggtctcttttaaactatttttaaaaccagtcataaacttaattagtttttcttcttttactacagttgttgcttcaaactgcatcttttgtttagcaagtatctctactgtttttacttcaataatcatttttttacctcatttctatattttgacttctataactaatctttcatcataatcattgatagcaaagccacttacagttgaatttaagattttgtcttttatacagtccttatatttcttatccgtagtgattaatacataatcttcatcactagaaactctattactgttaacaatactgattttgtaattttcattttgaaaagcttccaaaaattcttttaatgttttcatttccatcacctctttaatatttgattctttcaacattctttttcttttcctctacagaagtattcgcatatatttcagtcgttttaatatctgaatgtcctaaaatcctagcaagctctgttgagttgccaccggcttttaaaaattgtatagaaaacatatgtctgaatgaatgcggatgtgcctttgctaaatcaatacctcggcacattccacatatctttaaaattcttctttcgactgttctttctgttatcattgaaccatcattctttttttctgatggaaataacgtaccagattcaatctttttatctttggcatatgcaagtagctctcttctcaaatctcctcgcataggaacactacgttcctttcctttgttgaatacagttacatatttttttgatttgctctctttgatattttcaactgtgtaatatttaagttctgatacacgaataccggtgtatccaaatatcttcatgatcatgtaagtttccatatttccagtctttttagcctttgatagcatacgtttaaattcttctggtttgatgacattttcaatcgatgtcttttcctgctctttgataactttcaaacgatagtcacttacatatgtttttgcttttgtagagttgtattcccctttttcgttgagttctacatatttaacaaacttattgataatgatgatgtagttattgactgttttagtagaaaagttttctactatttttttcttataagaaatcaaatcactttttgctacatcttccttatcgaaaaaatcaacaaaatcacttacgacttttctatacttgttataagtagatgatgctttttcatccataacttcatcttcaataaattcatctatgtatgatttaagcatcgattttgtcaattttattttcatctcagatgtttctccttacgtttttttttcagtaaagtctttctttctcatacgtacatagatgtagtacatatgattgactttgttatagcggatttcatgatcaagataggttttagatttataattgctattcatataaactgatacatttgtatcatcagcaatcatatttctaatcttcttcttagaaaaagaagtatagctttttctttcttttggctttttaagacctttcgaggatttccacctcttttttccttttggatcttttgacaaataattagcaagaccagacagttcatattcatctggttcaagttcttcgacttttgttcttattccatttgtccataagtccttcatcacttttctatcgatacctccatcaataatcaaatgatgatgaaccctaattttcttttgaagatcatactccgtcacatagatatatttggcattttgaagcttctttttctttcttctatagttgatttttctaatcaacttgtaaacttccttttcagcatcttcaatgcttggtggaagattttcatttgaataagtcaaatgcataatgtaatcatctttagtgaagttggaattaatcaatctaatgaattgctttcttgaatttctatcatttagatttttctgcgctttccttgattttctttttaccttgaattcttgaaaatcctttttattgaaaattggataaagttcaacctcaaacatatttccagcacttattgttttagcaacataatgatgatcaatgctgtttgtccttagaagattttctatttccttttcttctagctgattgataggtgtatcatacaaggattcatagtcatattctttatctgtgtatttctttttcgtcgacttgttaggacgcattacaagagatacaaggcatcatagaaactatatttttaatagaatatatctactttttttatagaaatatgctataataattgtgttaggttaatataatttctagatgccattgaccattggttgatggtttctttttttattgaaaatatttatctatgaaatccttgctttcttgatacatctcaccttttatgagttcattcgcttccaaaagcacttttcttttattttcttgcttattcaaaatcgcacatagctttccaaaaatcattacatcactcaaataataatgcgcagccaatgtatcaaaatcatcacatacacccgcattttcaaaatttttaatgtttttcaatacataaatatttagaaaatcattgtatgtatctctttgcccatcttttgattcgattgatgacaaatcaagaaacaattgagttgctactggactgcagtatttttcagtatccatatattttctctcctttcaaaaaaataaaaagctattatcaaaacgtatttatcacttaaaaacatcgtatttttctctttttatgtttgtaatcaaaatcattttgcaaatttggaggtatgagaatgattgataatagcttttcagaggttattacctcttagcaatcatagaatttttgtaaagggacttgtgtatcgattgtagtaagagtctctatgattgctaacagataagaactatctgttatatttagaaaatgattgacaatagcgcatcagctatcattgttagcaattttgcaaaaatcaaaagaacaactatgattgtgatcaatcctctagaagaaagtgtttcaattttcatttctttaattcttctatttttcaaccatgaaattactattttcattttttagttcatccatttcttttaaaatgcgtttcttttcaatatgcatttctctaacttgatactttaaagcaattactttattcgttaattgaaaccacatttcttctaattttttgtaattttttattaaaaacatgattataattacttgaactatattagctataaactgaactatattagctataaacgaaaccaacagaaccatatgtattctcctttcaatgttaatattgaagtttctcaactgagaggaacctgccatctgagggaagttcaacaaatgaaacacatacgtacaaacaaatactagtaaatggcatttaatgacaagttcctttcagctgagaaaatatttttattaaactttatttaagatttcttccatttttagtgacaaatctaatgttcttgcttcctgaatagcgttaaataaatattgatattcttctttgctgataatgttttgaaggtacatgatttcaacgtatgcatctaactttccgctaaaataatctttcaaattttcagttcttagaagatctaaaaagcatctgtcaaacctaataatccaaatagttcgtctattttttataactttcattttatgaatccccctttgttccaaatcttctcattaaccaactgtctagcttagttgtatctatatgccatttagaagtctttcccggcgctttatatgcaggaaacccttttatttttaaaaactgtttcaattgatgttcagtaaaaccatatggaacaagttccttaattgacatgtatctttttggatataaattatttgtggtagtattttccattttcacgtgtctccttttttatttttagtggtagtattttttgagtagattatttatctaccgcttccgcaaaaaaaatatgatccctttgctcattggaaagttctaaaatcttttgaatatgttttatttcttgtgcattgaattcaactatattattgattttataacttaatgaagtgcgcgaaatccctatttttttcgagagtgtgtctaaagtaaaacctttcattctaataatctttttaatttctaatgtatctgtcattttatcacctccattttagtagctaatttatctacctcacaaacatagtacatctaagtagactatatgtcaactatatttgaaacacttttcaattaaagttgaatatttagccaccacatgttagtataatcttataaaggaggtgtttgaaatgggcataggagatagaataaagcaacgaagaattgaattgggaatgtcacaacaagaacttgcaactgcaatgggatatacttccaaatcaacaataaataagatagaacttggaaaaaatgatgtatcacaatctaaagtagtcaaattttcaaaagttttaaatacaactccatcatatttaatggactgggatttagatgatgaaaataatgatgttccagattattctaaagaaaataatgaatatattgaaataggtcaaagaatcaaaaaatgtcgtttaaatttaaataaatcccaattagacttagcttcctcattaggaattgaacgatcaacattacaaaaatatgaagcaggaaaaagagctatccctatcactgtattaaaagagctttcaattatcttttcagtttctattgattatttagtaactggtttaaattataacggaaacgtaaaaacaacatcatatcctataaatgaagaattatcatatatgattaagaacactttaaatacagaagctacaatcaaactaatagaatttgctagatttttatcacaagacaagaaaaatttaaaatagttaaaattatttagatgattatgaatggagaaaaatatgaaatatgttagaaaaataatagacaattactgtgtattagatttagaaactactgggctttcaccaaattatgatagtattatcgaaataggaattattaaagtaaaagaaaacaaaatcgttgacaagtataatagtttaatcaatccaggatttcttattaatgaatacattacttctattactggaattacaaacgaaatgttaaaaggtaaaccaaaaattatagatttaaagaaagaagtacttaatttcataggtaacgatgtactagtaggtcataatatctcttttgatgtttctttcttacaaaagggatttaacgaagagttaaaaaatgaatatattgatacattacaattttgtagaaagctatttaaagaattaagtcatcatagattaactgatatgtctaattatttagaaatttctagaaatgaacatcgctctatgagtgattgcttatgtactaaagaactttatgactgtattaaagaaaaaatgaaaaataatggtttagaaatcaatgatatatttgctaaaaaaaattattctagcaaaaatatagatatacatgccattaaaccagataatattgaaattgatgaagacaatttcttttacaataaacattgtgtctttactggcaaacttgaaaaaatgattagaaaagatgcaatgcaacttgttgttaatgttggaggaatacttgataattcagttactaaaaaaactaattatttaatattaggaaataatgattattgttcatccatcaaagatggaaaatcaagtaaacacaaaaaagctgaaaaatataaattagagggtcaagatattgaaatcatagatgaagacactttctataatttatttaatttaaattaaaaaagtcagtggctggcaccactgatctacacatgaaaatggaaaatactaccacatattttcaaaacataaagaaaggatctattatgctttttcttcatgagcaaatttattctatcatatttgctcatagatttaaagcaacaaataaatgaacaaggatgataaattatggctaaatataaaaaaagaaaagatggcagatatgctacttctatctatttgaataagaaaagattttatgtctatggaaaaacaatctcagaattagaaaaaaataaacgtcaattattaatagattacgaattaggactttcattacattcaaaggacgtcctttttaaagattataaatatgtttggtttgataataaaaagccatctataagcgctaaaagtattgctagttacgattcaatattaaaaaatcattttactttaatcgattatatgaaagtgaccgatataaaaaaatcacatattcaaaaagtaattaacgaattaattgataaaccaaatactgctaataaaacttatatgactttaaatcaaataatggagaatgctgttgatgatgaaattataaatagaaatccatgtagaagaattgtattacctaaagttgaaaaaaaagaaaaaagaattctaagtgatgaagaattttatttaacagaagttgctgaatttaatgatcgtgaaaaaatgtttgtaatcatgagcaagtattgcggacttcgtccagaagaaacaagagcacttactaaggatgatttttttcttactcaaacaagtggatatgtaagaatcaataaaactgttgtctacgtttcaaatcaagcaatttttcaaaaattcactaaaaacaatactagtgttagagacatacctctatttgctaatattttgccttttgtaagatattatttatcaagtatacaaactaataagctatttacaaatctttcaagtaagaaagatgaatacctctcttgtcaatcttacaaatggttgataaagaaaatcaaagataaaattagaatgaaggcattggaactaaacattgaatttaaagaagatggatttaccccttacacatttagacacacctttgccaccctactttattattctggtgtaagattaaaagaagctgaatattatatggggcatgctgatagtaaaatgctcactcaagtatatattcatttagataaaacttcattaagagagaataatccattagaggattttataaaaaataaattagaattaaataaaaaaaacatttatgaaaaactactctcaaatgagtagtttttttgacaactttttgacaacgcaaaaaccaaccaaatccatctaaactcattctaattcatttaaataaagtatctaaaacaagatataaaaaaagctcaaacctctagtaaaacctagtgtttaagccttctaataaaggtaatgataaacaaagaacgatatttagtttagtaaaaaaagtataaatacagaggttcaaaaaatacagagggccaaaaatacagtgactaacaaagtgatcctctgtattttgaaaatatttaaaaaggtaactcaaagtagtgattattgtattagcaagcagcgtaatttgggggcaaattacaattttagggatgaccctaagacccagagaaaggagtgaaatgtcacatgaaacgaaataaagaagttaaagtgagatttactgatgacgaattaatgcttttaaacagctatgttttgaaagcaggttataccagccgagaaaattatatgagaacaactttgttaaaaagtgttccaaaagaacagccatcaattgattatcaaaggctaatcaatgagtttaattctattggtaataatctcaatcaattggtgaaattagcttattatcagccattaattgaacaagagtcattatctgttctaacacagttaaaatctcttatatcattcacagaatcaatgataagaggtgttgtataatggcaacaacaggaatgtgggcagtaaagaatcgtttagaccatttagttaattatgtttccaatccatataaaacaattggattggaaactgttatcgattatacgactaatggtgaaaagactattgaaaaaagatatgtcacttatcttaactgtttatttgataatccaaaattaagcatggtcaatacgaagaggcatttccatgatgaaagcgaaatactagcatttcatggctaccagtcatttgaagaagatgaagtcaatgcagatttggcacatcagttaggtgtggagtttgcaaaaaagatgtggggagataggtttgaggtgattgtttcaacacatttggatactgataatattcataatcattttctattaaactcaacatcatttgtagatggaaaaagatattgtaatacctataatgatattcaaaatatgagaaatatatctgatgaattatgcagagaacataatttatcagttgtagaatttaaacaatatgtaggcaagtcaagaaaacaggttttccataatgatagacttaaagaaattgttagagaagcagttgatcaggtaatcagtgtcagttatacagatagacaattctataatgaacttgaactagaaggctatgaaatcaaaataactgaaaggaatatttctgttaggcatccattacatcgcaaatttattcgtttgaaatcattaggtgatgattatacaaaagaaaaactaattgatagaatattagattttaataaagataaatataatacatcaccatatggacgattaggatttgatattaagccatattgtcagcaatatgaacaacgaagattaacaggattacagagattgttccttcactatcagtacaaattaaaaatcttaccacgtaataatagatgcaagttaagtccgtttgaaaaggaagaattacaaaaagcagtacaaaagatggaggaatttaatcagcagacaatcattctttgtaagaataaaattgaaacttttgatgatttatacagccatatggataagattgaaaatgaacttaaccatcttatcaaggaaagacaaaaagcaagaaatcaagtgagaaaatataaaactaaagagcaaaaagatgaacaaaagttaatagcaaaatcatatacaccagagataggaaagttaagaaaagaattaatgtattgtcaaaaaatagaagaacgttcattaggtatcaataaatttttaaacgaacatgaaaaacaaaagagaagaaaggaaagaacaagatgaaagaaattgaatacattgaaattaatggattattatatccaaaattaacattaccgcctcaaaaggaaatacatttaacaaggtttggtagaaagagattgcagtatctaaagcaatatcgaccaatattttatacaaatttattaacaagtggtgaattaaatgaacatctgcaaatgatagatgatgaagcaaatgtattatatgatagattgattgaacaatataaagttaaaagaaatattactaaagaacttaaagaaaaagatcaaatgaaatggattcaagagatgaataacattcaaaactgtgttgaagaggttattaataaacaaattattcatatttaagggaacttatagcagagttcctttttatatttgaaatataatgactttcttgtaataaatttgtataacatgatttattaaatataaattttaaggtagcatatactatgactgaaaaagagaaaatgattaatataatcctgctaatcctaaattggagttataacttgcaaaggtaaataaaatttgtactaagtataataagaaagcatttaatgaaattaatatgaaatcaaaacttttaagaaaaataatgaagacaaaaggtaataagaaaaaatcattggttgaggaagcaatcataagtttgttaaatgaccatgatgcttattcagatgaaatctataatttggcagaagaattagatataagcaaatcaacacttaaaagagcaagagctgaacttacaagtgaaggaacaatcaaaccaaaaagaacaggttctaataaaggtaatgataaacaaagaacgatattctaataaaggtaatgataaacaaagaacgatatttagtttagtaaaaaaagtacaaatacagaggttcaaaaaatacagtgactaacaaaatgatcctctgtattttgaaaatatttaaaaaggtaactcagagtagtgattactgtattagcaagcaacgaaatacagaccacaaccacacaaagtaccgaaatcacgaacaggagcgataatattaagaaaattattgacaatatatatatcacacaataatcgtaacaggtttacgtttgtaaaaagacgtaactatacagggagaaagcaggctattctggctttacggttgaaaccttatacgatacatttatacagacaacaccccgaatcagcttttggttggacaattccaaccaaacaccacagcaaacagcagagactattctgaacgccaagaagccggtatgattgttacatataaggggaagaaaaatttcttttaggtacttgctttcctaaaactgatgtgatagaataattttgttctagaaaaggagtaaaaaatatgcagcaaggtattcttaaataaaactataatcaaatagtaggaacaaagaattatgatagtccctttcgtggggggcttagtttttgtatccaattttaagaatacttttaccttatcaattttgacatatccaaaaaacagcaatcataaataggtgtatgctgtatatgtgtatgtccgcaaattataatccccagtggtaaaagtactttactgctggggatttttatgccctttagggctgtaaaaggaggacaatcacatgaaaataatcaatattggcattcttgcccatgtagacgcaggaaaaacaacattgacggaaagcctgctatacaccagtggagcgattgcggaacaaggaaacgtggataaaggaactacaagaacagacactatgattttggaacggaaacggggaatcaccattcagacagcggttacttctttttgctggaatgattataaaatcaatatcgtggacactcctggtcatatggattttttaaccgaagcataccgctctttatctgtccttgacggagctgttttagtcatttcggcaaaagacggcgtacaggcacagacccgtatattattccatgcgcttcagaagatgaacatcccgacaattatcttcgtaaataagatagaccaaaatggaatcgacctgcagcgtgtttaccaaagcattaaagataaacttaccagtgatatgattgtcatgcaggaggttgccttgtcgccaaagataaccataaccgatatttctgatttggacaaatgggatattattatttctggaagcgatgaactattagaacgatatgttgcagaggattctttggatatacaggaattacaatatgaaaagtgcaaaagaaccagatgctgctctttgtttcctgtttatcatgggagtgcaaaagacaatttaggaacagaaaaactgattgaagcgattacagaaactttcattacagaaacagacgatattcagtctgaattatgtggatatgtttttaaggttgagtatacagaccggaaaaaacggctttcttatttacgcctgtatcatgggacgctccatttacgggatgctctgccactgtcaaaaaagaaaaaaataaagattacagaaatgtgtattccgttaaatggtaaaatcgtcccggctgaccatgcttatccgggagaaattgttattttagctgatgatactttgaaactgaacgacattctggggaatgaaaaactcttacctcaaaaaacacagattgataatcccatgccattacttcggacaaccgtagagccgcaaaagccggagcaaagggaagccctgttaaatgccctcgtagagattgctgatacagaccctcttttgcattttgaaattgatactgttacccatgagattatgttatcttttttgggaaaagtacagttagaagttatttgttcgctattagaagaaaaatatcatgtgggcgtggttatgaaagagccttcggttatttatctggaaagaccgcaaaaaaaagcaagcttcacgattcatattgaagtgccgccgaatccgttttgggcatctattggtttgactgtaacaccgcttcctgttggaagcggaacacaatataaaagcgaggtatctctcggatatttaaaccaaagttttcaaaatgccgtcatggagggtgtgtgttatggaatggagcagggcttatatggctggggagtgacagactgccaaatttgttttgattatggagtttattacagtccagtcagtacccccgctgattttcgttttcttgcacctgtcgtgttggagcaagcattgaaaaaagcaggaacacagctgttggaaccatacctttcctttactctttttgcaccgcaggaatatctttcacgggcttataatgacgcactaaagtattgcgcaataattgaatcaaccagacttgaaaaagatgaagttatttttaagggggaaatccctgcccgttgtatcggtgaatataggaatgatttgaatttttatacaaatggaagaagtgtttgtattacagaattaaaagggtatcaggaaacttccggcgagcctgtgtttcagccacgccgcccgaacagccgtttagataaggttcgccatatgtttcagaagataatgtaatgtcttgcgcaatgcaagtgttcattgcttgctattgcgaaatatcattgataaaattagtatcaaagaggaggaactattttgaaccagaaacagagggatattacaacaggaaagcaaatacgccatctgcggacacaagcgggaatgacgcaagaagaattagctagagaattgaatgtcactcggcaggcattatcgaattgggagagagatgttaatgaacctgatttaaatatgttgaaaaaaatttgttttctttttggcgtttacatggacgattttgcgaagggggtaataacaaaaatggaaacatatgaaaaaaaggagaaacaacaatttaataggtacgatatggcaattggacttttttatgctgttggtatatttcttggcattggtattttctttgttggcggttttatgacaatgtcgggtgcagggtggggagcatcactatttggcggtggctgtttttctcttgtatttggcttgatatgccatgcagttattacattgagaagaaatgacaaatgatgacatatcctgctttcttaaaaagaagcatggaatgctgtattcccggaggctgatatttttagaaaagtgcactgtgcggcaatttagacttttcggccatatcgcgcaaaaaagccgctacttttggttttccaatagcggcggcctaatgtaggttggctctatttttgagtgtcgatttattatacccttgtcaaatgtactaacctattttaaataaataccagataaatacaccaaataaaaaacaaggactttcaacatacattgaagcatataaagaacacattatgtataccgttaatgctttttgcaaagctgttattcgctatgccgctattaactcatagcgtgacaggggcaaacggcgacaaagggaaatatactttgaataccttacagaagaaaagttttacagtattacaaaaataaaagcctataccattttgggaagaaaagatatataatagccgagacgacaacaatcagaagttatggagggtaacaatggaatatagtaaggaagatttaattgaagcaaaaaggcaaattttgggagggagagagaacatgggaacagaggaaagtaaaaaaatctgggagaaaaacgcacaattttgggataatgcaatgggtgacgaatctaatgaatttcacagagaggtagtacgtcccaaagtaacggaacttctatctcctaatcctgcggattacattttggatattgcgtgtggcaatggaaattattcttcgtatcttgcacaaagaggcgcttcgattgtcgcttttgattacagcaaaaaaatgatagagttggctaaaagacggcaatcacaatatgcaaaacaaattgaattttgtgtagcggatgcgaccaatagagaaagtatattagaattaaaaagaaatcgagcctttacgaaagcagtttctaatatggcaattatggatattacggatattgaaccacttcttatggctgtttatgaactgttggaggaaagcggaatttttgtctttgcaacgcaacacccttgttttatcacgttgactgaaaaatatatgacaccgcacagttactatggtatagcgattgaagggcaaccggaggagcagatttattatcatcgttccatacaagatatttttaacctttgttttagagctggatttgtcattgatggattttatgaagaatgtttcaaaaacaacaaagaaattcctatggtaatgatagtaaggcttaaaaaggtaaaacgtgatagcttaaaataaattcaagtttgttgggtaaaaagcaactaccaaccagccacagcccttttgggaggaaagggggattttccatgacctgtacagaagaatatcgggaaccatatcgagtacactttccatgccttttgcaaagtcgttatccgaaatgcaacgatcaacgcagcgaggacacggagcaggaagcacaaaagaaatatcccttgaataccttacagaaaaaagttttacagtattacaaaaataaaagcctataccatttggggaagaaaagacatataatagccaagacgacaacaatcagaagttatggagggtaataatggaatatactaaggaagatttaattgaagcaaaaaggcaaattgattcaacattgcataaattacgggaaacaataataacctttgaagcaaaagaaaatccagagagatataagtcacaaatcactttggcgaaaagacgaataaaggcttttgaaatagcaaattactttataggaaacgaaattgaaaacagttagtaaattcaaaactctggtttcgcggcaagtgaaatcgttaggcagtataaattaaatttgcaaagtcagtagtgatagttaatagcaagatgaaaaccaatggtatttctaatcaaaaaggaggataacaatatatgctaagtccgaaagaagtagtaaataaatgggtagacgcttttaatgccagtgatgtggacatgattagtagtctgtatgataataatgcaacaaaccatcaagttgcaaatgaacctgttgtaggagttgtggctattagagaaatgtttgcaaatgagtttgcaactgcaaaaatggtttgtattgtggaaaatatttttgaagatgggcaatgggctatcttagagtggaaagacccgttaggattacgtgggtgcggatttttccatgttgtaaatgaaaagatattattccagcgtggatattgggataaactttcttttttaaagcaacataatctccctgtaaaagaataatgagaagaaagttaaagtataagaaagggtacaaaaattgataagttgtttaacaagggacggttgcaggaataatattgcagttgtaaaggagtagctggctatgaaatatagcaaaataataatattaaagaatggtatggaatgttgtttgagaaatgcaactgaaagtgatggacagcttgtattagataacttcactttaactcatacccaaaccgactatttacttacatatcccgatgaaaacacttttgatgcagcacaagaaagccggattctgaaagagaaggaaaatagtgaaaatgaaatcgagattattgctataattgatggcgcagttatagggactgctggaatcgaggcagtaggggcgaaatacaaggtacggcatcgtgctgaatttggtattagtgttctgaaaaagttttgggaacttggaattggacaagcattgatggcttcatgtattgaattactatatattaaatataagatgtatcttagtggtgaacattttcccataaaatgaaaatttgtactaaaattgaacatattttttaaaggatgtcaaaatattgatgtccttttttttgaatgatatgataattttgctagcaagaaaggaagagaaaattgtacaaattattaatacttgatatagatggaacacttagggatgaagtgcaaggaattccaaaatctgcaaaaaaggcgattcatttatgtcaaagaaattattgcaatgttgtcatttgcacaggaagaagtatgggtacaatacaagatgatgttctgtcattgggggtagatggatatatcgcaggtggtggtaattacattatctatcacgataaaatactctataatcaatcatttgaacaagacttgatcaaaaaagttgttcatttattaaaaaatagaaatgtggctttttcaattgaaagtcagaagaaagtttttatgaatcaaaaagctaaagaaatttttgaatcaatgaatcaatttaaaataaagcattcaagtacaaataaacagttcattacagaaaaaataatttataaaaataatattgatgagtatgaacattaagatatacataagatttgcttatgctctaatcaagaaatatttagtggagttaaaaccatattacaagacaatatgcaattagcacaaagtgatgcagatcatcaatattatgaaattattcaaaaagattgtgacaaaggaaaagcaattcaacgattacaagaaagattaagcataaagcaagaagaaacaatttgttttggtgatggacaaaatgatatagtcatgtcacaagtagctgatattgtagtagctatgaaaagaagtcatcaaatgttaaagaatgtcgcaacttcggtatgtgaagatgtttttgaacatggtatttataaagaattaaaaagaagaagtattatataaaggagtaagatattgaaaagaaatggtgtctatagtggatctgcatttgtagaaaataatacaatctattatttttatacaggtaatgttaaattaacagataggaatggctatgattatattcatgaaggaagagaacaaaatacgatttgttgtaagagtgaagatggtttttctatagataagaaagagttaatcatgtcaaataaacattatccatcaaatatttcaaaacatgttagagatccaaaaattattaaaaaagatgaaaattattatctgattctaggtgcaagaacaaatgataatcaaggatgtgtattgctttataaaagtcaagatttgaagaattttgaatattttaacactataacaacgccaaaaagatttggatatatgtgggaatgtcctgatttatttgagttagatgattatttatttttagttgtctgtcctcaaggagtaaaacaatctcattttaattatgaaaatatttatccattatggacaagaagttatgactacaagagtatatgatgcgataagagaaaagcaattaaaatttttatcaaagaatcatggaaaaataattttttatactttaaatagctataagataatttaatgctaaatacaatcttttggtaatggacaaggagtttttaatttatataacttgattatgactacatgataaggagtattgtggacaaatattgatagtatatttttatcataatatatgaaaaattacactgaatcatttttatcaaataacataccaaaaaaataccaaaatatttcaagtaaatgataaataacaaaagatagaataaaatagaaatagtctaaacaagtatttgtcattataaaacatgtacttaataattaaaataatctagataaataaattcgatagtaatgaaagggatgattaatatcgttaaagagcaaaaaagttagattagtgtaattgattataattatatgatatagaatattatatgatactaagcatcttgaaaaaatgcttctaatttgatactattagttcatcaaaagaatagagcaaactaaaaaacatggaaaaaatagctgatttttataaaatcactaacctaaataggttagtaaaaatgtattcttaagtgaattcgaataattgaagtgagatagttggggttgttattgaaacaatcccactattttatattcactaaaaagaaaaaattttatgaatattacaattacacaaatcgcaaaacttgcaggtgtttctagaggaaccgttgatcgtgttattcatcaacgaggacgcgttgctcccgaagtagaaaagagaatacgtgatattatggatgaaaatgattatcatccaaatatgttaggaagagctttagctgcttctaaaacactacttacaataggaatgattatgattgaaaaaggaaatccattttttcaatagattcattcaggaatgaaagaagcaatctctcaatttagagattatccaatttcaattgattttagacatattaatggtgtagacgaagaagaatatttaaatgtacttgatgaattagaaagcaaagtaaatgctttaattatagcgggattacaaacaaaacgtattgtagaaaaagtaaatcaaattgcaaaaaaaaattcctgttatgactttaaatattgatttagaagattctaataggattggtttcattgggattgatgattataaggcaggaacttgtcttgctggattaacaagtaatttgacaagatcaggagaaaatgtgtcgattctttctggttcaaaaacaattcattcacaatcacaaagagtcaatggatttcttgatacaatgaaacaatatccagaaattctattaattaatgtaatttatacagaagataaacttgaaatatcaaataaacttttaaaagaaatgctttcaaagaaatactataagacaattgtcatggtagattcatggcttgcaaatgcgggaaaagttatagcacaaacaggttatgatgatatcaatatttttggatttgacttaatgccacaaaataaggaagcattaaaacaggggaaagttacttatatcattgatcaaagtgcttatatgcaaagttatgaatgtgtacataaagtatgcgaacatttgatttatggaacagaacttccaaaaggaaaaaactatcttcctattcatatttataataaatataatctagactgattctttaggttttacaaaagatgaaattggatttttattcttaagaattatttggacttttgactttattaattagtaattttattttaaaagattataatgagaaacatcatattaagtaagtaatctgaaaaagattgcttatttttttaatatcaacaaaaatctattttttgaacacagtagttgtttatgagaaatttttttcagttattaaaaataattatagttatttttagtaatatgttattatattactatattgtgaatttaatctgtctgttatagagtatcatgttattaatgaaaaaatgcattttttatataaatcataaaaaattatttacattatgcatggtctataaatacaattattaaataacgcaatattaatgatgaaaagaatatcataaaattcgtgggggggggggagagaatagatggtattattggtacaagaaatgaaagatttacaaagaaaattccatttaaaactgttaagtgaacaaaaaggattggataatgaaataaaaggtattaaaatcatagaagttgaaaatatggaaaagtacatagaaggaggagaaatacttcttacaagttttttcatatatgaaagttgtacaatttctcagtatgaaacacatatacaaaatttgatagataaaggtgtatctggatttattataaaaaatagtggaaacataaaaaattttaatatcaaactagatatacttaaaagattatgtattgaaaatgaggttgccctgtttgaattacttcgacaaaattattattgggatattattagatatatattagataatgtttttgatcaagaaatggcattattaaagtatcacaaagttacaaatgataaccttaaagaatatattttccacaaggaggcaacacctaaaaatattatagagcttctttatacaataattgataatccaatttcaatgtattatgaaaatttgagttgtcttgctacaacatatgaagaaaaaagtagttttgatttattagataacattaaagaatatagtccagagataagattgaggtataattatttaaaacaagatgctggaaaatataatcaatatattatacctattacttttataggaaatatacctattaaaattgtgattgatgaaaaaaatagaaagttaacaaattttgattttgttgcgattgaaaatgcgattgatgcattaaggtattcattcacatttgactttgcaaaaaacgaaatccataaaaagtatcatcgagatattttctttaatttagtaaatagtcaattaaattatgatgatactactgaagcagccaatatgttaaatcttaaagaggatgcttattatcgagttgtatcatttcattctattccagaagatcaaaaggaaaagtattctttggaacaattagatgaagttgacattattgctgatcaaatatcaatgttttatcctaaagagcacatctataaaaatgtatctcaaattgttatgttacaaaaaatggattctgataaagaggatgatgatagtataagatgtttaaatgaactgatagatattgtaaaaaaaagtatcagcaaaagagatcaaaacacaaattttaatgttggtgtaggagaaatcgttaaaggatatagaaatttaaaaaactcatataaacaatcaagaatagcaatgaaatttatgaaaatagctagaaggattactggagagataaataaatcaattgtttattattcaaaattaggaatattccaatcctttattgaattggatgacataaataaattaaaaaaatatgtaccatacacaattactaaactcgataattatgatagaaaacataatacagagttattacatactttaaattcatacataagaaataatttaagtgtcaaaaagacgtctctagatttaatgattcaatatcgatcagcttcttatcgcattaaaaagataaaagagattacaaatattaattttgatgacaacatagaattactttcaataagaaatggattaataatttttgatattattaaggtttattagattattacgtaaaagacggttattactattaaaaactgtctttttttattggaatgctattttaatatacactttttttacaaaaaaagtattattgattttcctatttgttgcattataaaaatcattattaaaatttaaaataaaattatagataaattaatactattcttattgatcatataaaacacatttaaaatagttttgcttagtttgcgtaataggatgtaaccaaataataatgctatgatatagattacgtataattttcctggataatatgttggacagctcattaagactaaatttaacttattgaaaaattaaaagaaagatggaagaattaaaaattaacttaattctaggtaaaaattatgcaaattactaatacaacagattatgcgcttcgtatcattgattatttatctgaaaaaggaaatttagctacagaagcagaattagctgataatttaaagataccaattagaaatatttcaaaaataatgaatattttaaaaaataacaatctaattaattctgaaatgggatttaatggtggctattctcttgctaagaatcctgaaaggataagttattttgatgttatctctgcaactgagtcttctatgaatttgaataaatgtttagaaagaaatggcgtttgttcaagaaattgtatagagacgtgcaatgtaaggaaagtattattaaaagttcaagaagatattaatcaaaatcttaaaaacattacttttgaaaattcatttaatcaatctgaaatcattgaaaaaagatatttattattaaaagttgacctaaacagtttagatatgaatattattagtatcaaatctaaatttagtgatttgtttaataactatatgacatatgatgagtttttatataaatttatcaatcattgtgtttctaaagaagacagagatagagtaaaatcttttctaattgattttaagaatagtgaaaaatattatcaagattcacaagtaaaatatcgctctgaggatggaaaaacatggatggatttagacaagcatatagatgatacgcaaatggtattgatgtttaaatcatatgagtacatttatgaaaatcaagacaagacgaatatttcttatttacaacaagacatgatgattgtcaatgaattttgggatatggtatctttattagaaactgtgttagctcataataaattagaagatcatgaaagccttcataatatttctttctttacagaacaaatatataaggaattacaattaaattttccagaatatggcatattggataatgaaattgaaaatatttctaaactagcaactattcatgatatagggaaaatatctacgccttatgaggtacttaataaaaaaggaaaactgacaaaagaagaaatggatatagtaaaaaaacatcctgaagatggatttaatatggcattaaaactaccgaaatgaaattcaacaaaaaactagttcattatgcttataatatatgtttgtatcatcatgagagatatgatggtcatggctatcctaaaggtcttaaaagtgatgacattcctcttgaagctcaagttgttggacttgcggatgcctatgatgcattaatcagtgaaagaccatataaaagaaaaattaatcatggtgaggctgtgagaatgattgttaatggtgagtgtggaagtttttcaccaaaagttattctttcgtttattattgcttctatgaataaaacgtggattgaaaaagtaagtaaataatttaaatattaaagagtaatctaattttgtaaattatgattgctttttttattacattgctttttacacatagtttacaaaaaatgtatgaattcttttcctattctgtgcattatagaaagattgtgaatatattagaataatattcagaaataattattatttaagataaattttgcaattttataaaaagtcgatataagaggtagcgtataactaaatcatcaatcactttattgtagaaaaacgaagatatctaaaattttaaaagtttcctagtttcatggaagtaaggtgatttgtttgttaaacaaaattaaaaaaataatttgtatagacataatggtttgggtatgtgttatctctttgtttttacaaactgttgttgtctatgcgttaaattcatctgatgattcaatttcaaaggaaactattgttgaaaataacacaagctcacaatcagatgattcaatagatatcagtgatatttatgaaaataatgtaataaaaatttataatacaaaacagcttcaagcaattggctcaaattcaattgttacatctacagataatgatgaaagtaattacggtactggtcaacaaatttcagtaaatgatgaatatataacatattctctttcttccaagtatcaacttatgaaagatatttcattaaatggaaatgacatatggactttaccaagcgactttacaggcgcatttaatcatggaactgtagatgaaaattcaacattgtatgattcatcaacagatacaatctatatttataatgattatcaattaaaaattattcaatcggataattctgaaaatgaacctgttatgtctcaagatatgttaccagagtgtgttgggatgggacaacctgtttattcagataatagttctaattatctaacttatagcaaatcacataactatgtattatcgaaaaactttacaggtgagatgccagaaactaaagcaaatcaaatatcaaatataagtactgaaaattgtgaaggacgagattttaatggtcaagttgttaaaacaatcggtgacaaaacttatattcttataggcaatgaagaacagttacgaaaaataggatctgatgaaactgtttatggtgcagtttatcaagtttatttacatgctgccaattggtatgtagatgaagatgaaaatggtaatccgataatgctatacggtggagatgccgatttagaaaaatctcaaaatggtaatgaagattttggatttggagaaaagaatatacatgataaggataaaaaacaaagtaaatatagttcgtatccatatatatggggaagatgcggagtcaatcaatctactggtgaaattgatccaacattggatatagataaagctaccaatcaaaaatattcaacaaatgctaattatattatttttaggaatattgatttatccaatgaaaattggacaccgttgatgttccaaggaacaatgattggtgcaaaagccgatgggcaatcaacactatggaataatgatactagcgttatcgattatagcaaagcaactgatttaaatataggagacaaaccagttatttctaatgtgaatgttagtcaaacatctgaattggatgttggagaacaaatgggagttggtttctttgccacattatcaaatgaagcaagtgacagtgatttaggattgagcaaaggaactgtaacagtaaaaaaccttaaattcaataaaataaatgttgataatgaaacaacaaaaacaaaatttgatcaaacgttaataagtggattaacttcaactttaggattaacattaggagcactattagatggattaacatggttacttacttttggaactgttgatgctggattaagagacacactcagcagtatattaaatgctcgtaaggatgacccaacagctttagctacgggatgttttgcaggtcgtgtagtgggggatgtagcaatatctgactgtgaactggatgatgtgaaagtaacaaatgccaatagtaatacaggtggatttattggatatatttcaggaaagacggagtatgatggtttatcaaaaggattaggtggaacggctactctattggcaaaaattttaaatgtgattcctggtcttggcttaggtgatttgattactattcttttaggaaacgctattccagtagataaattgatccctacaaagtatatcaatgcttatgttgaaaattgttcaatcaataatttaacaggaaatataggaacaaataatgataagattgaaaattctggtggatttatcggtcaacaaaaaggaactgtcgtaaaagattgccaaattacaaacagcaacttcaatgtcaaagctaataattatagtggcggatttgtaggattagctagagatgatgtcatagaaggtactttatcgggtgctttagatatagaaactcaattgcctaaaatgaatcctgaaagtttgtttttaaattgttcagtatctgcgagtgatttgacaatttcgggcaatggatatcaaggtggttttgctggagcaatggccaacacgtcggctataaattgtaatgttaatgttagtgataaattaacggtatcttccggtggagataattctggtggctttgctggaatcgcaacaattggatgggctgctgatttaggaaaaggtgatacgaaagataacttattaggtggggttgttgacttagttgtgaaacttttaagcagtaatcaaaatgcaacatcatcattactttctcttgctggtgtgagtccttctcatatattaggatgtcaaataaatgctccatgcagtgttgaaggaaaaaattacacaggtggattgataggcagaggtgatggtgtttatcttacaaaatctaataccgataatttaagtaaggtttcatattttaaaaataatatcttttcaatggatggaatcgaagaaaaaaatatcattattaatggtttgaaatccgtggatggtgaaaattgtgttggtggtatttctggctcagtgggaacagcaagtgtagcaggacttttaaatacaactttaggtgttgcagaatatttaggatttaatgctaattctatttcacttactggttctacagaaggtataactattggtggtaaaggaaaaagagttggtggtgcttttggtgaagcaatcggtggttctattagttcggttacagtaacaaatttaaataatatttcaggagaaaatattgtaggtggatttataggcgtatctggtccaggtgatcttgcaggaactgataatggtttgacagtaaatcttttaggattaaattatattttaaaattaagcaatcttctttctttgggacaagcagttgaagtcaatatagattcttcgtctgtaagtggtattaattctggatttactgtagaagctacgggatcaagagaagataattcaacaactgattatgtagcagctggatttgttgctaaaagtaatagtacaaaaataaatgatgcaaaagttaataatttgaaaacagtaacttctacagatgatggaggttactctggcggatttattggtatttcaaaaacaggcggtttagctgaagttggagatgaaacagaaataaaaaaattgatttcggctaatggattattaaatgctgtaggatatttaattccgtcatatcaacaatgttatgtaagttatatagataatggtggtgtacgaggagatattgcaggaggatttgttggagatttccaaagtggtattgttgaaaatgatgaaaataatgcttatgcaatacaaaatatttcatatgttaaaggaaaaacttatgcagggggcttcggtggaaaggtttattctggagctttagcagattcaacaaaaggaataagtattttaggcggtttagcagatttgaatattcaaatctctgatttattgagtttaatacaggtttatattcctattattaaaaatgctggtgttcaatctaatggattggtcgttagctgtgatacatataagtcaacggatttaaattcaggtagtgctggcggatatataggttatggtagtgctgtaagagtttctaatagtagtgtaactaagttaaaacatacaacagtaaaaacacctaatgcaaatattaatgatacagacagttcttcttattttggagagtcttcaagttatgccatttcagcacctaaaaatgctggaggctatgtaggaaaattagatataggttctacggcatctgttggtggtggattgaagacattgggaacaaatataaatttggcaaatattttatctgcgttagatgtaacagcttctaaaattgaaaattcagatgtaactggtgcggttggtggtttttctgttaaagcaaatggtttggatgaaaataaaacaattggtaatgcaggtggctttgttggaaccgactatggttcacaaattcaaaatagcaatgtcaataatttctcttacatcataggtcaagaaactgctggtggttatgcaggaaatattcaaccaggaagtgttgcagatgtattaggtaaaacggaaatcttaaaaggattaatttcagtagatagtttaacaagtgtgttgcaatcatttattcctatgatctataattctcaaactacttgtattccttgtggtggagcagttcgtgctgatgccataagtaatgaaacattaaaaggatgcgcgggaggttatgtgggttataacctaggtggtcgtattgaaggaaattctacaagaaaatggaatggaaaaatacctacagttcaaaaagaatgtgcagtctataggttaagagctgtttatggatatgaatatgcgggaggatttagtggcagaacggattgtgccaatacagttgatacaggaaatatcagtgtactttatggactcattaatttagataatccattatcagccttgagtgctgtttatccaactgaaactaatacagcaacttatggaccacttcgaggtttaacaacagaagtatggaattcttgggtaaaagcagtaggagtcaatggtgcttatggtaaaaaattccaagaacttggagaagttgataatcaagacgagttagataaaattattgatcaatatgcctatggctatgaagtaaaagctggaagaacaaatgctggttcaaacgattatcaaggcggtattgctggtggttatgttggtcaaatgaatggaggaaaagtaacttttgctaatgctagagatttaaaagatgttacagctttaaaaagcagtggtggttttgctggtgaaatgatttcatcaggagttgctaatgttggagatataaacttaggtaataaattaaatgtggtaggctcacttccaatattgcaaagtttcattcctgtggtaaaaacttcgtctgttataggttatcaatcaggagcaacaatatctactactggaactgattttgataatgatgaaggaaacagtggtggatttgttggaaaagttgttggtggaacaatacagggaacacaagatcagtattgtttggctgatcaattaaaagtaatcaatggaagtcaaaatgtcggtggctttgctggtaatattcaaccaggaagtgctgtgactttgaatacttcatccaatacaggattattatcaaaactacttaagtatttattaggcaatgcaggaaatcttgccaaagtattgaatgcgactctttcaatagttgattatgccaaggtggatgcatggaatgattatggattaagtgttaacggttcatatacattagaaaatgatgaaaatacaaaatatgcaaatcaagcaggtggttttgtaggtactgcaggaggagcaatttttggtgataaagatgcaaattcagtaagagttgaggcaaataatattagaaatgttgttggtggaagacatgctggtgggttctttggattggcggatgtttcttctgttgctcaagttggaaatgatgattctgatcaaattctaaatttgattaaattaggaaatattgatgtattagatgcctttagaacttatgtttatcaagcaaaagtaactggatcaaatgataatggactttcagtatgtgcaaatgatgaaagtcaggaaggaacattggacagtaaagtacagacaggaaatgcaggtggatttggtggaagcttgctagatggttcaataaaaaattcgagtgttactggattaaataaagtcaaagctaaaaactatgccggtggttttgttggtcacatgggaaagagtggtgtggttgatctagatgaagctggtgttggtacaggaaaattattaaatgccacagctggtgtcttagatatttttggttctcatagtgacaactgttcagttattggtattccagttggatttactatttcaagtgaaagtggtaaggaacctatttctggtggttttgttggttatgctgatttaggaagaatgagcaattgcaatgtagaaaacataaagaaagtggctagtgatcaaatagcaggaggctttgttggtaaaacaagttttgaatatttagctgatattgacttaggttctagctatttattggatccgatactttcaatcgtcaataaacttctagatattctatatgtgggagatttagaaaatgttggccttatagatatcaatttaggttcactattaaaattacaagttttagctaaaggaaatgctttatcagttactttgttaggattaactatttcagtagcacttgataaagatagaggagatggaacaagtgacctggcaaaaataacaattggtgattcttatatagaaatcccatgttcaaatattgatggaaatcatattgctgacagtgagaaagaaaatattaaagtaggacttatcaaatcaaacagaacaaaagtagatggatgctcgataacaggtattcatgatggatatgatgtttttggtggaaaagcaaatgattcacatgatggaagtgaagaaaatggtcaagcaggtggatttattggttataacaatgaaggattgattgaaaacaatgaaatgtatttagctgatacgattagaggaacaagtaatcaaataggacctttttctggaacaacgtctttaaattctagttatgactttaatacaaagaagaatattgaaggtaaagataatacgtacaggatttatagaacaaggagtgattccttgattgatattataaaaaattcatctttgtatagtaaaaaggattcagattttgataattggaatgtcttcaaaataagccattatgataaggtacaaaaatatgatgacttaaaagatgccaaattagcaaatgaaacagaaagtgaaaccgttgatttaaatgcctatgtctctccagcaaaagctgtattgatggatgatacagaagtatctgataacgaagatggtacgacacctgtcccttcagatacacaagatccttgcaatgaaaaagtaaacattactatcaataagctatggaaagatttaagtgataaacaaaaagaacgtccagatacgattacagtgacgttaacaagaacatatatgaaaggaagtgatgaaatatcagagaaagtaggggattatactttatcaactaatgatgtaactgattctaaaaatacttggcaaacaattattaaaggattagatgcctatacaacattagaagatggaagtaaagcttattatacttattcagttacagagtctgaagtagaaaattatataacatctattgaagaatctgatgatggatatacgtttacgataacaaataaagatatgcctcttttaccagatttaggtggaaaaggaacaatgttatttgttttagtaggtatagtaggtgtattagcagttttgttatcgtacaaaaaaagtaaaaaagcgaacaatattaaagaatagaggaatatgaaaatgaaaaacaaattaaagaaagtagtagcatatgtactttcatttatgatgctatttacaatgtcagcaatgaatattggttcagtatctgcagcaagtacaggcagtatcacattaaatgtggctcaacacgatataggtgctacaacatttagtgtatataaactaatggatgcaacttcagctaatgataaaattgcttatacggtaaatagcgatttcaaagaattttttaaacaaactgatgtagcaaattcagaagatgatgaagtggtatacaattatataaagaatcatgttaaaaacgatgattttacaactaaattaaaaacatatgtagctagtaagaatatttctaaagttactttgttacaaagtaatttgaaagctaataatttagaatatggatattatgctattattccatcaattgatacatataaaccaatgtatacaactttatcaaatagtaaccaaacagtatatttaaaaggtttagaaccagatgttgataaaaaagcagatggtaaaaattggacttcagcacaaattggtgaaactgttcgctttactgttgattcaatggttccaaatatgacagggtttgatcattatgtatataaatttactgatgcaatgtcatcaggattaactgtatcagaagctgatttaaatatgaaaattaccatgggtgatacagaattaacagcaggtaatgattatactgtaactgttgaaaatcaaaaaattatagttgattttggtgattttattaaatataaagaacatgcaaatgaaactttaaaattcgaatatcaagcaacattaaattctaatgctgtaacagatgataaaactaccaatacggctacaattcaatatggtcatgatgttgattcattaagtgatccaaaaacagatacaactactattaaaacacataatttaagaattactaaagtagaaacaggtacagatactccattggctggtgcaaaatttaatctttataaaggaactagtacaacaggtgagccaattcattttgttcaaggtgctaatggcacttatacagtaacaacagctgaaaatggaattactgaattagttacaccaagtactggtattattaatgttaaagggttagatgatggagattatagattagttgaaactgaagcaccagaaggttataacaaattaaaatcaccaaaagaaattaatattaaagcagaatcttctgataatggtgaaaacgtaacagtaagcggtaatgatattactgtagaaaacagcacagaatcatggttaccagaaactggtggtatgggtacagttatctttacagtagtaggggtagttggtgtgttagttattctttcaacttactttaaaaaaggtaaaaaagaagaagcttaattgaattattaattaaagtatctcatagatattaaatgtatgaaagatatattaagaaaaatcaaattatttgatgttattagagctattttattagtgtttttcctaggtgtattgctttatccaacagtaagtgattacctaggaagaatacatagctcgaaagctataacttcttacaatgatgaagttaaaggaatagataaagctacaaaaaataaaatgttaaaagaagcacaggaatataatcaatcattagtaaatactaaattatatgatccattttctacaacaggtaaaccaagtgaagaatacatgaatttgcttaatgtttctagtgatggcatgatggcttatctacaaatacctaagattgatgtgaagttacctatttatcattcaacaaataatggtgttttacaaaaaggtgtggggcatatggaaggttcttctttgcctataggtggaacaagtacgcatgctgttttatctgggcatagaggattaccaaattcaaagctgtttacagatcttgacaagatgaaagttggagatattttctatatttctgttctaggtgatacgttagcttatgaagtagatcaaattaaaacagtattgccctctcaaacggatgatattgaaattgtagatgatgaagattatgttacgcttgttacttgtacaccttattctgttaatactcatagattgcttgtaagaggaaaaagaacagattataaagaagcgataaagaaaacaccgaatgaggtcaataatggtatacatattccttatgaggtaaaattagcatttttaagttttattattataggaattattatatttatttggaggaggcgataacatgataaatgcaaaaagaatatttattattgtatttacatgcttattgtctctttcaattaataatgtttatgctcaaaatcatggttctttaacgattcactgtcattatttagatgtacacaaccatatttttaatattagtcaagatcatattgcgttgataaaaatagctgattatgatggtaatgactatcaagttttagataaatactctaaacttgttacaattaaaaaagatatgacagcgtctgagcaaaatggagttactactaaattgatggattatattaaaaaaaataatattgattatgatgaagaattaataaccaatcaaagaggagaagctacttttagagatttagactatggaatatatataatctatgaacataatgaaagtgaatttgcatataagatggaaccttttattatttcaatcccacttcttgaaaaagaagatgacggatcatatgaaaaggattatgatgtagatgttgaaccgaagtattcaagaatgagacctggaattgatgaagaaccagatgataaaattcctagaaatgatgagaattttaagaaagaaaaaaatttcagtcaaacatctaattacaaggataatcaaaaattaaaaacaggagattattataatcctgaatattggttattacttatgattatgtctattataatatttatcatgtttaatagggaaaatattagacattaaaatttttaagattatgtagaggaaaagtaagcgccaaataaaatagtgtatttaaagaagtcgattgaattgatataataatacatgatctggcatgatttccatttcaatgatttcgacattcaattgatcacagctttctttaatcaactcctttaagcgatcatccacaccatctacaagaacgggacgtcgatattttggacagaataccacatgatatttgcaggaataggtcacattattattcgatttgtattttatgggtatattatactaccgaaagctatctgacgatatgatttatcaataaaatcttaaaaaaagttgccttatatctccacagctgaagttgggaactttacgaaaacatttggtaaaagaggtgagtgagctttcttttttattaaataatagtagtaattctattcattttgtggtaataattgtactgttgaaataaaagattaaaaaataaatatagattatgggaggatgcaatggaagatttaagacaacaaatagaaaaaagaagaacatttgcgattatttcccatccggatgctggtaaaacaactttaacagaaaagttcttactctatggaggagctatccaacaagcaggaactgttaaaggaaagaaaaatagtaagcatgcgacaagtgactggatggaaattgaaaaacaaagagggatttcagttacctcttcagtattacaatttaattaccaaggatattgtattaatattcttgatactccagggcatcaagacttctcagaagatacatatcgtactttaatggcagcagattgtgcagtcatggtcattgatgcgagtaaaggggtcgaagatcaaacacgtaagttatttaaagtatgtacaatgagacatattccaattttcacttttattaataagatggatagagaagcaagagatccttatgaattaatggaagaaattgaacaagaattaggaattgaaacttgtcctgttaactggccaattggttctggaaaacgttttgcaggggtttatgaaagaaatgatcaagaagtcattcgttttattcctgtagatggtggaaaaaaagaagttgaaacagaaattttaaaagcggatgatccaaaattaaaagagtatgtggaagatgaactttatgataaattacaagaagatattgaattattagatatggcaggaaatgaatttagtttagaagctgtacgtgctggtaagttatcacctgtatgttttggatcggctcttactaactttgggattgaaccatttttaaaacatttcttaaatatgacaaccccaccaactcctagaatggcagatggtgaagtgattgatccttatcaagaaaatttctcagcttttgttttcaaaattcaagcgaacatgaatgctagacatcgtgatagaatggcattctttagaatttgttctggtaaatttgaaaaagggatggaagtttatcattatcaaggtaagaaaaaaatcaaattaaatcagtcaaaacaattaatggcagatgaacgtagtgaagtaaatgaagcttatgcaggagatgtcattggtgtttttgatccaggtattttctctattggtgataccattacaacaggtaaaaaacattttgcttttgaaggaattccaacatttgcaccagaacattttgcaatgattcgtaataaagatacgatgaaaagaaaacaatttgttaaaggtgttgaacaaattgcaaaagaaggagcaatccaaatctttactgaattaggtggcggtatggaagaaattattgtaggagttgttggtgttttacaatttgaagttttagaacatcgtttaaagaatgaatacaatgttgaaattcataaatctcctctaccttatcaatatataagatgggtcaaagaaggaactgatttaaaatcattaaatctttcatctgatacaagaaaagttcaagatttaaaagggcaaccattattattgttcactaatgattggggcgtaagatgggctcaagataaaaataaaggtttagaattattggaattttctaagaactaaaagtagaacttttagttctttttttatacaattcgaatgaaaaaagaattgatgacttcagtcagttgagcacatgaaatgtgcaaaatagaaaatcacttgctatgagggtggtgcaataagaaataatggctaaaaaggcaaattctttagcacatcgtcttcacaccgaagtatagacgaaaagtgatatataatcaactaaggaaagatataggagaaatattgagaacactctgtcgatataagggagtagaaataatagaagggcatttgatgagtgaccatgtacatatgttagtaatgataccaccaaagttaagtgtgtcatcattcatggtttaccgttattacatgtcgatgaaccaacaattcaaatggtttttggaacaaatacttcaccatttgctggtcaagatggtaaatttgtgactgctagacaaattgaagaaagattatttaaagaaacaaatagagacgtttcattaaaaattgaaagaatccaaaataaagaagaatggatcgtttctggacgtggagaattacacttatctattttaattgaaaatatgagacgtgaaggttatgaattacaagtttctaaacctaaagcaatcatgaaagaaatcgatggtgttttatgtgaaccatatgaagaagtaactattgaagcacctgatgattgtattggagcggttattgaatcacttggatatcgtcgaggtgtcttagaaacaatggattctcgtgatggacaaacacgtgttgtttatacaattccgtcaagaggtttatttggatttatgacaaatttcttaacaatgacaaaaggatatggaattatttctcactcatttattgactatcgtccaatggaaggtgaaacagttggtaagagaaacttaggtgttttaatttcaattgatagtggacaaacaacagcttattcacttggaagtgttgaagaccgtggagtaatgtttgttgggcctggtgtggatgtttatgaaggtatgatcgttggtgaacacagtagagataatgatttaacagttaatgttactaaaggaaaacaaatgacaaatactcgttcatcatccaaagattcaacagttgttttaaaaagacctcgtcaatttaatctagaatcttgtttagattatattaatgaagatgaacttgttgaagtaacacctgaaaatattcgtttaagaaaacgctatttaactgaaaacgaaagaagacaacaatatagaaaaaataacggataagagctcttttagagctcttttttaaatttgacactaatttgtgtaatataattttgtggatttgcttcagtaagttcatcaattaaactttcatcataagcaatatcatctaatatgagatgattttttttagcataatctaaaaaaagatgataggattgataagatgtttcataagttcctttatgataaataactaaataattaccagaaggtataatatcataattttcattttctagttgattatctaaaattgtgtaataatattgataaaaagttttctttctatcagaggctaacatcttcttccattcaactattccactaatggcgtgacctaaggaatggttttgttttcttctgtatttaatatgttctcctaaaattttatattgtgtgatttcattactgttaaaagaaatgtgttcacttttaataattttaatctcatctcgatattcgatatataccatatctgtcaatatttgattagctttggtaataagttgacattttgtttccatcatattgatcattttatgataggtagtaataatctcttttaaagtattaatcttattagaaaataattcatacgtactttgagcattacgatgttcaatataatctttgatttcttctaaagaaagtcctattttttgaagagactgtatagtagctataatgtctaattgggacattaaataaaatctatagcctttttcatttttatatgcaggtaaaaagataccttttttttcataaaaaattaaagtttgacgactcactcctgaaatacttgcaaattctgttggtgaaacataaatattatccattttttagccaatcctttcttaaattaaaaaattcacaaataacacttgattgtatagttacaatatagcataaaataaacgtagagttaagaaacaggagggaaatatgttagaagtcaataatttttttcatggaacacgtattgtagaaggatatggtgttttaaatgaaacagggaatgaagtaaaagcattagggtttaagaaagtgttgattgttacagatgattttttatctaaatcagctcattatcaagtattaaaagaaagtttagaaaaagaaggaattgaatatttattagaaacgaatgtaaaacctaatccaagagcagaagattgtgatgcaatggcaaaagttgctattgaagaaaaggtagatgccatcattgctttaggtggagggtcatcaatggaccaagcaaaagcagttgctgcaattgttacaaacggaaaaacaactgttgaatggggagatgtagaattagaacattcaattttaccacttatttgtattccttcaactgctggaacaggaagtgaagttacatggtgtgcagtcattacagatacagcaagaatgtataaaatgacagttggggatcctattcatatgattccaacacttgcaatttgtgatccaacaattactttagatttaccgcaatcacttacagcatcttgtggagtggatgctttaacacattgtatagaagcttacacagttaaagttcatcaaccaattacagatgcgcttgctttaaaaggaatttcattaattgctcaaaacttagaaaaggcttatgaaaatgggcatgataaagatgcaagaagaaatatgatgatagcaagtacaataggtggaatgtcttttattagttctaatgttggggctgttcatgcttttgctgaaactgttggtgcgtggtttgatacaccacatggtgttgctaattcattatttttaccttatatcatggaatacaatattccagcatgtatggatagatttatagatattgctcaagcattaggaattgaaagaaatggtatgaatgatcaagagtatgcatatagtgcagttcaatatgtaaaagatttaaatagaagattaaatattcctaaaattaaagaaataaaaggaattactgaagataagtttgatgcaattgctcaaagatcagcagataatattttatcaaatgataatgcaagagaaattcataaagaagattacttagaattattaaaaaaagcttataaagatgaaggagaaaaagaaaatgcataagattaaaaaaattgttgatttatcatgggaatttacagctgatacaccaatttatccaggagatcctgagccatcagttactgtagcaacaactttagaaaatgaaggttataatttatcaacattagtaatgggaacacaaacaggttcacatgtagatgccccttatcatttttctaatgaaggagcaacaattgatcaaatggagttggatttctttttaggagatgctattgttgtaagagtcactgataaaaaagctgaagaagcaattacaatggaagatattgaaccttataaagaacaaattacacctggtaaaattgttttatttaatacaaattggtataaaaaaagaggaacagaggaatttttccatcatccttatgttaatggagaagttgcacattatttagttgatcaaggtgtcagatttattggaattgatacaattaatgctgatcaaacaggtggaacagaattcccggtacatgatttattttctgaaaaacgcttaatgattggagaaaactgggcttattttgataaaattgattttgaaaatccatatgttattgcaattccaatgaaagttgtaggttgtgatggttcaccagtaagagcaattgctgttgagtgggaggattaatgatggataaaaagattattctaggatatacacgtagattacttgcaattattccttctattttcttttgtgctctaggggtcgctttacttgtttcaccagaatggggaagcgatcctcttactacttttgaaataggattatctaatgtttttcatgttcaattaggaacagcagcacttgtttttgaaggaattgttttctttgtatttttaattattagaagagatttagtacatttaggaacattagcttggtgctttttaataggtccatttgaaaatgtttggttagattttttagcaccaatattaccacctgtagatgcgatgtcatttggtttaaaagttggttgcattattgctggatctttaatcattatccttactctagcctactatattcctattggtcttggatatcaatcgagtgatatttttgcttttgcaatggctgatttattacataagagttatggtataggtttatcagtttcttattgtattttatttgccttgggagtttttatgggagcttcttgggggataggaacactgattgcagtttttgtttatggaccagttattgatcgcttattaccttattttaaaccttatacttataagatagctgggatgacagatgaaaaagatgactaaaaaacaaatgtatttgtatggcttacctggtcttgcaacattgtttacatttacaatgtttacgacttatggtttatatttctttacagatgttgtaggactttcaggaagttttgcaggttttattatgactattgggactgtttgggatgccattacagatcctctagtaggaatgatttctgatgcaagagatcctcaaaaaggacgaagaagaccatttttaattgcttttgccattccttttggaattgttacatggcttttatttacgtcatggaattttgtagaaaccacacaaaagatttattttattgttgttgccattttattttatacatttcaaacattaatagatattccttatacatctttaagtggtgaagttacaaatgattatgatacaagaagtcgattagccactattagaacattttgggctatcgtaggggttgctttaggaagtggtatcatggcatatacttctcttttagctccttttgtaggaagtataaagaatgcttggtctgtttgttttgctatttttggttttatttgtacaatcagtattttacttggttggaaagtttctaaaggttatgaaaatcaagaagtcatcattaaagaaaaagtaacttttaaagatttattaaatggaccattaagaaataaagcttttttacatttaacagcagcatttatttttgctattttagcacaagctgtatttttaggcgtattagtttattaccttacttataatttacaattaaataatatgcaagtgtcgatggtcaatattattatgtggattgttgctttgttttgggtgtttcctattaataaatggtccatcaaatactctaaagctaaagcttggtgtatttcgatgggaatttggtttgtatgtatgattgtatttcctctgtgtatcttaaaacaaaaatcagctattggtcctgttatcatgacaagtattttagtagttggacttaatgctttatatcaagtgatttatgcaatgattagtgattgcgtagaagttgattgtttggtaaataaggttagaaaagatggtattttttattcaatggctactgtttcacaaaaaatagcagcagctattggggtaagtatcttaggaaactgtatggataaaattggttataatggtcaattagcaacccaaagtttagcaacacaacatggaattgctcttttatttataggtgtgacgtgtatgtgtttacttttatctattatttgtatgatgacaaatccacttacgaaaaaaagatatcaagatgttttagaagctttaaagaaaaaagaacaaggtcaagaaattaatattgaagaatttaaagatttgttaataataaagatgaaaagatagattttgaataaaaatctatcttttctttataaaatagaaaacatcaagtataatatgtttgaagaaagtaggggataaaatgatagcaggtatagaagttaatctatcattaattttaaacattattcgtacaattattgatttattattagtgtggtatattttatatttaggaattagtatgtttaaacaaaatatgagaacgatgcagttatttaaaggggttctcattattttgttaattaaattagtaacaagtgttttagggctttcaacaatgtcttatttagtagatacggttttgacttggggaattattgcggtaattgtaatctttcaaccagaaattcgttcattacttgaaaaaatgggacaaactaaaagagattatcatatggaacgtttatcaaatgatcaaaaggaacatttgttagatgaaattgttgattcagtgacaaagttatcagaaacacaaacaggggccttgattacttttgaaagaggacaatctttaatagattatattaatacaggaactaaaatcaatgccgatattaaatcagaattatttaatacgatcttttgggaaggaacacctttacatgatggggcagttattattaaagatgaccgtgttgtttgtgcagctgcctttttcccaccaactcaaaaggatctttcacctatttatggggcaagacatcgtgctgctataggaataagtgaaattactgattcattaacagttgtagtttctgaagaaacaggaacgatttcttttgctatcaaaggagaacttattaagattccaagaaaggaattaagagcaagcttagttaatgaactaggttggtttaaatcagaagatgaagaaggtgatgaagatgagtaaaaataatcaagaacatcgtgattcaacaactgattttttcttaaattttatttcaaaagaaaaagaaaaaccaaaaacagaagaaaaacatatcacttctcaatctattaatgatgaaatagattcaaggggaagagcttttgtaaatggtgctattaaagtgatgaattttattaattctactttagatagaatgttacaatcaggattatctttaaaaatattatcatttattttagcaacgattttactatttacagttaatggaggtaattttgaaaatgtattttcaacacctaattcaggagattatattcaacaagtccctgtgaaaatagaaaatttacaagatgattttgttgtagctggaatgccagagactgtaagtgtaggcttagttggtccttctattgatatttataatgctaaattgatgaaaaattatgaaatatatgctgatttttcgggaataggggaaggtgaacagacagtagaattgaaatcaagaaatttctctaatgatttagaagttctcattgttcctcaaacagtaacggtaacagtttcacaaaaggtaactaaaacgtttagtttaggatatcgttttaaaaatgaagatagcttaaaggataaacattctgtttcagtagatagtattgaacatagtgaagtagaagtaaggggttcacaagataatattgataatgtttattctgttgaagcagttattgatttaaagggagtgacagattcgtttactcaagaatgtaaagtaaaggcttttgatcgaagtggaaaagctttaaatgtaagtgttattccttccactgttaaagtggattgttcattgtctaattatagtaagacagttccacttgtacctgaatatacaggaaatgtggctaatggatatgcaatcgatcaaatgactttttcaaaagataaagtaaagatttatggtgatgaaagtaaattaaaggatattaataatattaaagttaaagtggatgtaagtgatttggaagaaggtcgtacatttaaagacttaaaattgttaagtgtttcaggagttaataagatgtcatttactaaagtggatggaacaattacgcttgttccttctgaacaaagacaatttacagatatgccaattcaaataaaaaatggcaaagaaaacaatgtttctatgtcaagcgatacatgcaatttaacagttattggtacaagtgatcgtattaatgctcttacaaatgatgacattaaggtctatgtagatgtcgttgggttaaaaaagggtcgacataatgtgaaattagaagtagaattaagtgacgaaactttaacatatcgtttagatagcgatgaacagattcgcgtaaatataaagaaataggagagatttaaaatgggaaaatatttcggaacagatggctttcgtggggaagctaataaagatttaacagttgaacatgcttataaagtaggaagatacattgggtggtattttggaagaaataaagatcatgctcaagttgttattgggaaagatacaagaagaagttcttatatgttagaatatgcacttgttgctggacttacagcaagtggtgctgatgtttctttaatgcatgtaacaacaacaccaagtgttgcttatattacaagaacagatggttttgattgtggaattatgatttctgcttcacataatccatattatgataatggtattaaggttttagattgtaatggtcataaaatggatgcgaaggttgaaaatttaattgaacaatacattgatggtgaagtagatgaaattccatttgctacaaaagatgaaattggatgtgcaacagattattcagtaggtagaaatagatatttaggatatttaatgtcaattcctacacgtgcttttaaaaatattcgtgttggtttagattgtgcaaatggtgcaagttctaatcttgctaaaagtgttttcgatgctttaggagcaaaaacttatgtgattcatagtgaaccagatggtttaaatattaatacaaactgtggttctacacatattgaatcattacaagaactagtaaaatctaaaggattagatattggttttgcttatgatggtgatgctgatcgttgtttagctgttgatgaatttggaagagttattgatggtgatttaattctttatgtttgtggtaaatatttaaaagaacatggtgaattatctaatgatacaattgttacaacagttatgtctaacttaggtttatataaagcgttagataaagaaggtattaaatatgaaaaaacagctgttggagataaatatgttaatgaaaacatggtgaaaaatggtcattgtattggtggagaacaatcaggacatatcattttctctaaacatgccacaacaggagatggtattttaacatctttaaaaattatggaagcagttattgaaagcaaaaaaacattagctcaattagttgaacctgtaacaatttaccctcaattaatgaaaaatgtatatgtaagagataaaaaagaggctcaaaatgatgttgaagtacaaaaagtcattaaagaagttgaagataagttaggtgatgaaggacgtgttcttgttcgtgaatcaggaactgaaccagttgtacgtgttatggttgaagcggatacaaatgaaaaatgtttacaatctgtagattatatcattactaaaatgaaagaacgcggatttgttatcgaaagataaaatcacatattatcacaaaatattgccatatattatggcaatattttaactataataggtcataatagaataggatacaaatgaggtgaagaagatgttatttaaaattaatattatagatgatgaaaaaaatctaaatgatttggtaagaacttatttagaaaaagaaggctatagtgtttgctcgttttatacgtatgatgaagctttacttcataaagatgatgatgtacatctatggcttatagatattatgttagataaggcaagtggttttgaattgtttaatgaaataaaggcaagtaagcctaaaatgccaattatatttatgtcagctagagatcaagaatttgatcgtattattggtttagaaaaaggctcagatgactatattacaaaaccatttaatattaaagaagttattttaagaattaataatttattaaaacgtgcttatgataatccatctaagatacaaatagatggttatgatattgatttagaaaaaagaagagtcttctataacaataatgaaatcattttaacaacaaaagaatatgatctacttgtttactttttaaataacaaaggattagctatttcaagagaacaagttttatcaaaagtatgggacgaaaattattttggtagtgatcgtgtcgttgatgatacacttcgaagattgcgtaaaaaaatgccagaaattaatattcgtacgatttatggatttggatatcgtttagactaatgcttacgaaatattctttacaaaaacaacttgttattattttttcaattattgcaataggtgttttagcaattctattgcctattattgataacaacttaacacatgttattgataatgaaatgtatgatgttttgacacgctcacaaaatgatttttactcatatgatttttctcctgattatgcaggttcagataaacaaatttatcattttacttataacattaatgaagatacgcttacaacagcgcaaaatatttctgctaagaaatatcaaatattagattatgtttttcaaaatgatctttataagatggttaagaaaaataaaaagaaattacaagaaaaggttaaaatgcaagaccaaacagtatattatcaaattgtaaaggcggatgattctaattatattatttcacttgtttatagtgattattctaaaacattgattaataatctaaaggagcaagttattgatatcttttatgttgcttttttaattattggacttgctttgtttatttgggtttcatctttaataaaaccattgaaacttattaaaaattatatagatgatataaaaaatgataaagaaagtgaattgcatattcaaagagaagatgagataggtgttttatcttcttcgttaatagaaatgaaagaagaaatagatcgacaaaatgaaattaaagaagaaatgattcataacatttctcatgatttaaaaacacctattgctttaattcaaacatatgctcaaagtattaaggatgatatttatccttatggagataaagattcatcagtggatgttattttagaaaatacagatcggttagaaaagaaagtaaaaagtttactatatttaaatcgattagattacataagtggacaaattggagatgaaacatgttcaatgaaagaattgattgaacatattgttttccaattaacagctatgcattcacaaatagaaattcttacagatttacaagattcatcttttaaaggaaaagatgattattggcgtatttgtattgaaaatattatagaaaatgctgctcgttatgtacaccatgaaattaaaattattttaaaagatcaatatttagaaatatttaatgatggtgaacctatagataattcaaatcctgaatctttatttcaaccttatgaaataggtcataaaggacaatttggtttaggattatctattgtttataaaacagtaacaatgtatggatataaagttgaagctgttaatagagttgatggtgtaagttttattattcaaaagaaagattagtcgaatgattaatcttttttttaaaaagtgttgctttttttgataaagagtggcactattttagagttatcaattctcaaaaatagagaaaaagagtataataaactttaaggagtgagtaaagatgaaagttgttgttgctgctggaggaacaggtggacatttataccctgctcttgcattagttgaatatataaaaaaacaagatccaaattcaaaatttttatttattggaacaaaggatcgtttggaatctcaagttgttccccaacttggatatgattatgttggtttaaatgttaaaggattagcgggtaatcctttaaagaaagctcatgcagctttgttatttgttaaatctattggaaaagcaaaaaaagttataaaaaaatttaatcctgatattgttgttggttttggtggatatccaagtgcttcagctttagaggctgctgcaagtttaaaaattaaaacgatgattcatgaacaaaactcaattattggtttaacaaataagattcttataaaaaaagtagataagatcatttgttgttatcaaaaagcgtatgaagaatttcctcaagaaaaaacactattgcttggaaatcctcgtgcaagtgttgtcagccatgaagttcctaaagatatttatgataaatatggtttagatagaaataaaaaagttgttacgattgttatgggatcattaggatcacagacagttaatcaaacgatgaaggaatcgatgaatcaatttgttggtaaagaatatcaagtactttatgttactgggaaaccttattatgaatcaatgaaagattataaaaatgaaaacgtaaaaatcatcccttatgttgatgatatgccttctttaatgcatgcgacagatcttattgtttcacgtgcaggagccagtacccttgctgaattaacagctttaggcgtaccagctattttgattcctagtccttatgtagcagcaaatcatcaagaatataatgcacgtgaattagaaaataaccatgctgctaaaatgattcttgaaaaagatttaacaggagaaaaattgatttctacaattgatagtgttattaatgatcaaactgcacttcaaattttaacagaaaacgctaaaaagttaggaaagccaaatgcagttgaagacatgtatcaagaaattatttcgatgttaggagactaatgatgaagtttgaaaaatattatgaagaacttaaacaattagatgttggaaaagttcttaaagatgaaccgttatataaacatacaacttatcgtgtaggtgggccagcaaaattatttataaaagttcaaaatgtcggtgagttgattgaagtgataaagtattgtcgtaagcatcgtattcaactttttgttattggaagaggttcaaatttattattttcagataaaagttttgaaggaattattatttcccttgaagatatgaatcaatatcatgtcaatgggagcgaagtaactgcccaatgtggtgttacaatgattaaacttgcttatgattgtgctaaaattggtttgagtggttttgaatttatgggaggaattcctggaaatatcggtggtggtatttttatgaatgcaggggcctataaatcatgtttaagtaaagttgttaaatcagtaaaagtattagatgaacatttaaaagtggttgaattatctaaagatgaaatggatttttcatatcgacattccatcattcaagaccatcctaaatggattgtcttggaagctacttttgttttggaaaataaaagtgttgaagaaattaatgaaactttagataaaagaaaagaaagaagaatgtctacgcaaccttggaataaaccaagtgcaggaagtgtttttagaaatccagaaggtgcggctgcatggaaatatattgatgatgcaggtcttagaggttatgaaattggtggagcacaagtttctccaaaacattctaactttattgtaaataatggttatgcttctgctaaggatattcatgatttgattttttatgtccaaaaaacagttcaagaaaagtatggtgttttattaaaaccagaagtacgttttattaattgggagtcttaagatgacaacgtatgtatataatgaacatgatgaaaatcaagtgttaacaatgagaaataaattaaaaaagaaaaaaagaaaaagaagaattaattttgtgcttattgttttgcttttgatatttttagtgatttttttctttggagatatgtctaaagtaaaaaaaataactgtttcaggatgtcatttgacttctgctgaagagattattgaacgattgccggttaaatcaaaaaaaacttatttttttaaagtaaataaaaaacaggttgaaacagaggttgaaaaaatgatctttgttgaaaaagcaactgtatcgaaagatttgatagggaatataaagataagaattaaagaaaacaatgcttctttatatggctatattaataatattttatatgttgcagatcaagatggcatttttgaacaagatcaacaacaaaaatggatttcttatgtacaacgttgtccacaaatgatgaattttgacgaagaacatttccgatcatttgtaaaagcatatgtcaaattaccatcagttgttcaaaatcaaatctctagtattgtctttgaacctgatgaaaaagatcaaaccaaatgtaagttggaacttgatgatggtaaggttttttatgtacgtattgaagacatggaaaaacaacttacatcaacaaattattacttggttattcaaagttatcctgattataaatactatgattatttaggaaaaaatgtctatgtatacaattaaatagtgtatgaaaaaagctacgtgtttgaaactaaaacctttaaatatcgtagcttttatgataatataatgatatatgtagtaaggggagatagacatgaatgaagtttatgcagtattggatataggtagtgcttcaattgaattgttagttggtgaaattatcaattctaatttacatgttcttttttctaaaaaggtccctagtcatggtgtaaaaaaaggcatcattgaagatgaaaatttattagtaaatgatatcaaaggagttgttcaagaagctaatgattttctagatggagaaatcaaagcagttggtcttacaatccctactattcgttctaaactttatcaaagtaatagtagtgtatcacttagtgatcatgataagatttctaaggatgatattgtaagaggtttgaaactttctactaaattcaaaaaatctcatgaagaagaggtggtttgtgtaataccagttcgctttaatggtgattttggaattagtcaagtacctcctataggagaagcttcaagaaatttaattattgatacattgatcattacttcacaaaaacagattttatatccatatattatggccgttgaaaaggtaggtttagaagttatggatatttgtatcaatgcctttgcgtgtgcaaaggaagcttttgatgtggtttatcttcaagaaggtgcattgattattgatatgggatataaaacgtcaacaatatctttctacaaagatggatatttaaaatatttaacagtatgttcagttgggggttataatttgactagagcaattgctcaacatttacaaatttctatgaatcaagctgaaacatataaagtcaaatatggttctttggattatactgttggacaagaggatactattcatacaactgagcttccagatggtcgtaaagattatacacaaaaagattttgcgggtattttagaagaagctgcagttgatatgttaaatgttattaaagaaaaaatgggtgttatcgataatggacaacattatgaaacactgattgttggtggcggaggagaacttgagctactagataaagttgctggtcgtgttttagaaggtccagtgagagtttatcgtccagatattattggcattagagatatggcatttgtttcttctgtaggaatgattttttatatgtctgatcgtgctaaatatcttggtccttatgaaacatctgttgttttaccggatatttctaatacaatggctgtgagatttaaaggacttacgaaagtaaaagatacaaaagagaaaactggaagatttagtagattactagatactttctttggtgaagaagaatagataaaagagagggtaaatcatgaacgaagaattagattttgaacaagttgcaaaaataaaagtaatcggtgttggtggcggaggaaacaacgctgttaaccgcatggttgaagaaggcgttagaggagtagaattctttgtcgcaaatacagatgtacaagtattacgtcgttcgcctgtagaaaataaaattattttaggaaaagatttaacaaaaggtttaggagcaggaggtaatccagaagtaggaaagaaagctgctttagaatctgaaggagatattagaactgcccttgaaggtgcagatatggttttcattgctgctggtatgggtggtggaactggtactggtgcagcacctgttttcgctaagattgctcgtgaattaggagcattaacagtaggtgttattactaaaccatttacttttgaaggaatgaaacgtaaaaaacaagcaatcgaaggtattgatgaattacgttctaatgtagatagtattattgtggtttcaaatgaccgtttattacaactaattggtggacgtccaatgcaagaagcatttagagaagctgataatgtattaagacaaggtgttcaaacaattactgatttaattgctgttcctgcatttatcaacctagactttgcagatatctgtgcagttatgaaaaatagaggaaatgcgttaattggtattggtatgtcatcaggagatgataaagcaaaagaagctgcaaaacgtgcaatttcttcacctttattagaagtttccgtagcaggtgctaaagacgctattattaacgttacaggtggaccaaatatttcattatatgatgctaatattgctcttgaaacaattactcaagaagttggagatgacattaatacttatttaggtattgctattaatgaaaacttagatgatgaaattattgttactgttatcgcaacaggattcgaagaagaaaaggaagaagtaactgtccaaccttcagtagcaagacctttaggtgaagaaccacaaacttttgaatcatatgatgatgacgaagatgatgatgatggttttccaccagcatttatcaaaaatagaagaatttaataagatgagctaacgatgttagctcatttttataaaggaggaaatttaaatgaaaattggatttataggattaggaaatatggcggggacaatttgccaaggtcttattaaaagtgattttattgatggtagcgaggtatatggatatgatataaatagtcaacagctgatgatgtttgaacaagattttggtattcatgtatgttcaagtgaacaagacgttgttaaaaattgtgattatttggtgatgggggttaaaccaaatgtcgtagaaagtgtcatttcaaaaataaaatcagtcattgatcaacaagtgatcgtttcaattgttgctggttatggaaatgataaatatgaagaattattaccgggaacacatcacttaacaattatgccaaacacaccagctaaggtattagaaggaacgactttatttgaaaaagacaatactttaacagctgaagaattaaattatgtacaaacaatgtttgaaagcattggtgaggtttatcttattgaaaattatcaaatggttgccggtggtgctttaagtggttgtggaccagcttttgtttatatgtttattgaagctttagcagatggtgcagttttaaatggtttgcctcgtgatttggcttataagcttgccagccaaactgttttaggaagtgcaaaaatggttaaagagacgcaattacatccaggtattttaaaagatcaagtttgttctccaggtggtattacgattcaaggtgttaaggctttagaagaaaataattttagaaacgctgtgatggaagcaatcgatcgttcaaaaaaataatgtgtagaaagtatggatttttgtccatacttttttaaatgtccaatcttttttgacatcttttttacttgtcatcatatatgatgataaaggggtaagcaagatggaggtctatgttgaattaacttattgtatgaatggtattttatttatcatgacttatgaaatgatttcattattgcttaatattaattggtcatttttgaaaatccttttcttgagttttttaagtaatatatcgattgttctcatttatatagactatttaccatatataagttttttatactggattgtcctttttttatttatttttaaaaaacaatttttcttatattttccagtttttttaattgtttatttttcaatactattctttatcaataccctaataaaagaatcatttatatacaacggaatcttgattactcccataaattataaagatatagttattgttgttatgatatgtgtttttttaatcattgaaacaatttatttaatttatacaaaaagaaaaataaaacaaaaagatgatctatatgatgtaacacttatttttaataataagatttatcatctttcagggtttttagatagtggtaatcatgcaaactatctaggttatccacttatttttattaaaaaaagtaaaattgatacttatcaacaattagatacattgattattgatggcttaaaaaaaagaaaaatagatattattttagttgaccaagttttagtaaataagcaatctttaagaaatgtttatataggtgtattggatgaattagattatgattgtttattaaataaagaattgatgggagggattatttgatgtggcaaatgattagacagtttttaaatacaaaacagtatctttattatataggaagacatgatattttaccgcctcctttaaaaggtcaacaagaaaaggaaataattgaaaaagcagtttctggggatcaaaaagcaagagatttattgattgaacataatttaagattggttgtttatgttgctaaaagatatgacaatagcgccaattgtcctttggaagatttaattagtattggcacaattggtttagtaaaagcaatcaatacttttaaggcagataaaaatattaaacttgcgacgtatgcttcaaggtgtattgaaaatgaaatacttatgtacttaagaaaaaataataagattcgttatgagatttctttagatgaacctttaaatattgattatgatggtaatgagttattattaggagatatcgtaggaacagatgatgatcttgttgaacaagagatgttgaaaagtgatcaaaagaaaattttttatgaagctttaaaagaattgaatgaaagagaaaaagaaatattgattttaagatatggtttatctaataatgatgaattgacacaaaaggatgttgctgatttattaggtatttcacaatcttatatttctagattagaaaaaaagattataaaaaaattaagaagtcaattaaattatgatgaagtgaaatagtatatttttatcaaaaaaagccacactaattttggtgattattgtggaaaaagaaagttttatgagcactatccctattcaaaaaactctttctaaagaagaattatatacattgattcaaaattatcaaaagaatcatgatcaaaaaagtaaagaaatgattattctttctaatacaaaattagtgttatctttaatgaaaagattttaccaaaaatcaaatcattatgaagatctgtttcaagtaggcatcgttggtctaataaaagcagtcgatcattttgataccaattatcaattacagttttcaacgtatgcagttcctttgatcattggtgaaatgaaacgttatttaagagataatacacaagttaagatttctagaccaatcaaggatttagcttatgctattttaaaagaaaaggaaaaatatttaaatcaatatcaaagagaaccaacgattcaagaattatcacaaaatttaaatattgaaaaacaaaatattatagaagcaatgcaatctactcaaagcattgcttctttccaagatgttgtaggaaatgataatcaaaatgaattatcattatcagatattgtctcacatgatccagaaacattgaaacattatcatgatcaccttgatttaaaaaatgcctttgattgtttaaatcaaagagaaaagaaagtaattcaagaaagatactatcagggttattcgcaatgtgaaatagcagatgagctttttgtatcacaagcgcaaatttctcgaattgaaaaaaaagctttagaaaaattacataaaaaattagtctaaagcatattttataggggtgatcgtatgagatttgtatcattacaatcaaaagatgtgattaatgtttatgatggtaaaaaaatagggtatattgcggatattgaattagattggtgtcaaaaatgtatacgtgctttaattgtcgaaaaaatgaatttttttcattttttttgtttttttaaagagcctcctgtcttagttattccgattgaatgtgtgatttctttaaaaggcgatgtgattttagtgaatattgaacaggtttagctagatttccttgttgatacctttgataatcaataaatgtatggtataatattgaggaaataaaaggaggatgacttcatgggttacggtgaaaaagtaaaaaaatggtttttcgatgaagatggggatggagaagatattgctgaagattatgatgctgtagaggttgatactgtacctaaaacaagcttatttgaacaagcaaaactttctaaaacaagcgaagctgtgaaatcattaaatatgaataaagatagtcatttagttttatttgaaccacgttcatttggagaaactcaagatattgcaaattatttaaaaacaaaaaaagcaacagttgttaatttacatcgtttacaaaaagatcaagctaaacgtgttgttgatttcttaagtggtgttatttacgctattgaaggtgacattcaaagaataggacccaaaattttcttatgtacacctcgtaatatttctgttgcaggaacaattgatctagatgaagatgaacaagaagattaaaaagtatggtttccatacttttttaagttatgtttgaacattttaaaggggaagaagtctttgtaaaaaaggtacttgattatttggatcaagtacaatataaacaaagacttattttaacgcaatttttagatccgtatcatcaatcaattgttaaaagtgttattgggcatcaagatgaagttcaagttttagaaaatggtggttttattcatagtgaaagtcaaagaataattattgctccttatttttatgaaatagaaaaggaagattttgaaatcgttgtttgtaagattatttatgcaaaaaattttgaaaaattaacacatcgagatattttaggtgctttaatgtctttaggaattaaaagagagttatttggagatattgttgaaaaagacaaagatttttatttagctgttgatcgacatatttatgaatatttaaaagatcatttatcaatgattaaaagaagtaaagtaaagtttgttgaatgggatgaagaaatagaagtaaaaaatgattatttagtaaaatcatttattgtatcttcatttcgattagataagatcatttcttctttttataaaatttcaagacaaaaagcagcagaatttattcgtgctggtcatgtaaaagttaatcataaaccggttgaacaaataaattatttatgtaataataaagacataatatcattcaaaaaacatggtagagtgatgtttgttgattgtaataaacaaacacgctctgataattatgtggttgaagggtatttttataagtagggagtgaacatgatgttattgaaaaaacaagtatttggttataataagtcacaagttgatgaattgatcaatgaaaaagataatgaaataaaacagttgaatgatcaaattaaaaaattacaagaagattatcaacaattagaacatcaaaaatcattattacagcatcgtgtaaacatccaagaacaaacaaatgaagaaattgcacgtcttgcattaaaagaagcaagcgaacttattgacaaagcgaaaaagaatgctaatatgatactgagcgaatcgctagagtatgttcgttcgttgtctggtgagatgagcgactttaaggcgcaagctgttaaatttagagcttcggtcgaaaaaatgtcaaaagatatccttgagtctattgaccagtcagaagtttataatttaattaatgaagataaatacgatgaaggagacagtttataattagagttttaagagagctgatggttggtgtaaatcagtaacaaagattataatgtatcactctggagtagccctttgaattaagtagaaggtgacgttaatcgcgttaagatttcaagagcgtatgaaaatacgaattaaggtggtaccgcgatcacatcgtccttaggatgatgtgtttttttatttttaaagagaggaaagaaaaaatgaattacaaagacacattattaatgccaaaaactgactttgaaatgcgtggaaacttaccaaaaaaagaacctaagtatgtagaacgttggcaagaaaacgacatgtataacaaagttattcaacaaaacgaaggaaaagacagctttgtcttccatgatggtcctccgtatgctaatggaaatatgcacatggggcatatgttaaacaaagtcatcaaagacgttatttgccgttataaaaatatgaatggtttctatacaccatatattcctggatgggatactcatggtttaccgattgaaaatgctattcaaaaattaggtgttaatcgtaaagaaatgcctacagctaagtttagagaaaaatgtgatgcttatgcacatgaacaagtaaataaacaaatggaacaattgatccgtatgggaacatttgcggattataaacatccatatttaacattacaacatgaatttgaagcaagacaaattgaagtttttgctaaaatggcaatggatggattaattttcaaaggattaaaaccagtttattggtcaccatcaagtgaatctgctttagctgaagctgaagttgaatatcatgatatcaaatcaccaacaatttttgttaaattccaagttaaagatggtaaaggagtcttagataacgatgttaatttcgttatttggacaactactccttggacaattcctgctaacttagcaatctgcttaaatgcttcttataactatgcattagtagaaactgaaaaaggaaaattaattgtcttagatactttagttgatgaattaatggctaaatttgaaatcacagattacaaagttgttaatcattataaaggatctgaattagaatacatcacatgtcaacatccattatatgatagagaatcattagttatcttaggagatcatgtaacatctgactctggtactggatgcgttcatactgcacctggatttggggcagacgacttctttgtaggtcaaaaatataacttaccagcttattgtaacgttgatgaacatggttgtatgatggaagattgtggtgaatggttagctggtcaatatgttgatgacgccaataaaacagtaactatgaaattagatgaaattggagctttattaaaacttgaattcatcacacacagttacccacatgattggcgtactaaaaaacctattatctttagagcaactgatcaatggttctgttcattagataaaatcagagataaattattaagtgaaattgataatgttaactggttaaatgaatggggacacatcagaatctataacatgattagagatcgtggagactggtgtatttcacgtcaacgtacttggggtgtaccaattcctattttctattgtgaagatggaactccaattattgaacaagaagtatttgatcatatttctgaattatttagagaacatggttcaaatgtttggtttgaaagagatgaaaaagatttattacctgaaggatatacaaatgaacattcaccaaatggtatcttcaaaaaagaaaaagatatcatggatgtatggtttgactcaggaagttcacatacaggtgtgatggtagaaagaggatttaattatccagtagatctttattttgaaggtagtgaccaatatcgtggatggttcaactcatcattaattatcggtgttgctgctcatggtaaagctccttataaaactgttttatcacatggtttcgtattagatggtaaaggaaataaaatgtctaagtcattaggaaatacagtagatcctattaaacttgttaaccaatatggtgctgatatcgtaagattatgggctacttctgttgcttatcaacaagatgttcgtatttctgatgaaatcatgaaacaagttgctgaaggttatcgtaaaatccgtaatacaatgagattcgttttaggtaacttaaatgatttcaaagcaagtgatttagtagaaatcaaagatttacctggtgttgatcaatatatgttagctaaattaaatgaattaatgaaagcttatgatgaagcttatgcaaattatgactttgctacagctaaccaagaaatcttaaattactttacaaatactttaagttcattctatatggatttcacaaaagatatcttatacattgaagatgcaaattctccacgtagaagacaagttcaaactgttttatatcatcatgctaaaacaatgatgaaattattatcaacagtacttgtatttactgctgaagaattacatgatcatttccattgtgatgaaaataaagcagaatctatcttcttagaaccaaaatatgaattatttgatattgaaaatgaagaagaagttttagcttatttctctaaatttatggaagtaagaaaagatgttttaaaatctatggaaggtttaagaaatgaaaaattaattaaatcgaacatggaaacaaaagtaacattatctttaaaagatgaatataaagatatcgctaacttaaaagatgatttaaaacaattatttattgtggctaaagttgaattagttgatgatacaactttagaagaatatgaaactagctacattaaagttgaaaaattcaacggtgtacaatgtccaagatgttggaactatttcgatgaagatgaaatgaatggtgaattatgttcacgttgtgcaagtgtagctcatcgtgtagctgaatagcagataacaggatgtatcgaaagatacatccttttctttttaaaaaacaattttgtaatgaaaaataaagcgaactgtgttattatttacgagattgtaggtgagggagtatatgaaaaaagaaatattaggtaaatgtatgctattaatgtctgctcttatttggggaagttcttttattgtgatgaaaaatgctgtggattttatttctccatttacgctattatgtatacgttttgtgttaagtacaattttcatttctattttattttttaataaaataaaaaaaatcaaaaaacaagatctattaggtggttttttagcaggtctagccttatttagtgctttttcaattcaaacatttggtttgcaattgacaacacctggtaaaaatgcttttttaacagccgtttattgtacgattgttcctttattaagttggctttattttaaaaagaaacccgataaagcacaaatatttgcggctatcctttgttttattggagttggttttgtttctttagatagttccttaaaggtaaatttaggtgatctttatactttgattggtggttttttatatgctgttcatattattgtgtgtgaaaaagcaatgaaaaagacatctccaattattattactgccttacaatttgcatttgcttctattttttcatttatagcagcctctttatttgaagatatttcagttgttttccatattgattcaagtatttatcttcaaatcttatatttggcattctttgccactacattatgttatttatttcaaaatgtgggacaaaaatttgttaatgaaaatatagcagcattattattaagcttagaatctgtttttggagttttcttttccatattatttggacaagaaataatgacacttcaaattgaattaggatttatgattatttttatttcggttttgatatcagaaacaaagttatcttttttacatagggggaggaaaacaatgattaaaaaattatttacaataactttatcattgatgatgatttttacatcattcgtaccagttttcgctgaaggggaagaagtcaatattgtaggacaatatggaattgtcatcgataaagataccggacaagttttatacaataaaaatgcccatgataaaatgtatccagcaagtattacaaaaattttaacatgtattgttgctattgaaatgttagatgatctagataaaacagctacgattacgcaaagtgatatcgatacagtttgggaaacaggagctacttctgcagactttactgtcggagaagttgtcacttatagagatatgttgatgggagcaatgttaccttcaggtgcagatgcttgtcgtgctctagctaataatacgtgtggtagtcaagaaaagttcgttgaaaaaatgaatcaattggtaaaaaaattaggattaaaagattctcattttgtaaatacaacaggaattcatgatgatgatcattatacaacagcatatgatatggctaaaattacccaatatgctttaaagaataaaaaatttgttgaggtctttgatagatatcaatatacgtcaagtgatggtcaacatcaatgggtcaaaaaagttatttataaaagtaaaagagaccatattgatacatcaatgattgaaggatgcaaaagtggttatacaagcaaagctcaaagtactttatcaagtttattgaatatcaatgatcatcattatgtttgtgttgttggcttttctaaaaatagtgatggctataatcattgtaccgtaaacgatacccttgctttaggtaattatgtaaaagatcattattcagttgcgaatattattaaaaaagatacaaaaatgaattctgttaaaataaaaaatggtcaaacaaataaagttgatgtcatcacagaaaaagatatcgaagctgttttaccaaataattacaatccatctgatataaaatataaatatcatttaaaagatttaacagctcctgttaaaaaagatcaaaaagcaggaacaatggatgtttactatcgagatacaaaattagaaacaatttcacttaatacaacacaagcagtagatgaaagtggttctgttgtttttatgagaaaaatgaagaatgttgttttaccatgtgtaatggcagttgtcatcattcttgtggttttattattagtaagaaaaatcatgattaaacaaagacgtaaaaaaagacgtcaacaaagaaatcgtaaaaagtaggtaaacctactttttttacttacatatacttaattattatgcgtatatataagtagatacattgacatatacttatatatacgtataatataagcaagaggtgagaaatatggcttataaatgtgtatttagtgatattgatggaacattattgaattcaaaacatcaaataagtgaaaaaacaaaaaagaaagtacaacagttagctatacaaaatattccttttgtccttgtttcggcaagaatgcctaaaggaatgcattattttttagatgaattacaaataaaagcacctatggtaagttatagtggaggtttgattttagatgaaaatcaaaaagtaatctattcaaaaggattttcagtagaaatggcgaaaagactttatgaatatattaaatattattatcaaattcctgttaatttttatgttgagaatcattggatggttgatgaaatagatgaaggaattgaagaggaaagcattattacagggttgaaacctgaaaaattggatttaaatggaattaaaaaggttcataaactattagtgattgctgaatcaggaattgttgatcgtttagaaatgagcttaaaagaaaaatttagtggtttaaagatttataaatcaaaagatacttatttagaaattatggatgaatcggtatcaaaatccagtgcaattcaatttttatgtgataaaatgaaaataggtcttcatcaaacagtttcttttggagataactataatgatttagatatgcttcttttaacaggaaaagaatttgcgatggctaatggagcgcaaggtgttttagaaagtattccaacacatacgctttctaatgatgaagatggaatcgtttatgcattagataatttagtaggtgaataaggtgtatcaagaagaaagaatttataaaatattagaaatattaaaagctaaaaagacaatgaccaatcaagaaattatggatcaatttcatatttctagagatacagcaagaagagatattgttcgtcttgtaaatgaaaatttggcagttagaacacatggtggtattacattaaatgatgtacatcaaattggaagttatcaaacaagaaaacaagaaaatgaagagataaaaaatgaaattggaaaaatagctgtttctttgagtgagaacaataaagtaatcttttttgatacttcaacaacggtggctgctttatgtcaatatgtagaaggtaatatagaagcttatactcattctttagataatattgaaatattatcgaatcattgtttatgtcagatgattggtggaacttactttaaaaagaatcgttatatgtatggaagtcaaacgttgaatatgattgatcaaatttattttgatttagcttatgtagcagcagcagctgtgatggaagatggtatttatgttgaagaatttgaagatgctatgattaaaaaaaaggtagcaagtcgaagtcaaaaagtttgcttagttgtagatcatagtaaatttaataaaaaaagttcttataaagctttagcttttcaagatattgatgttcttgttgttgattggttacctgatacttatcgagaaaagatagaaaaagcaggatgtcaaataatatatacaaaagaaaagtagattcgcatgaatctactttttagcaagcattttatcaaaaaaataaccaattactctgaaaatcatggctaaaccaaagatagataaagcaccaattgtttcatatttatggaaaaggaatgtacataaaaaatatgtaatgattcctaatgctgctcctaaacctgttaataatgtcatgaaaacatctttttgttgtttcataatttcacctcaagaactattctaacataacaaaaactaataaacaataaatagaagttgtgctataatctagataaagtgaaaggggaagtctatgtataatacgttgatttttgatttagatggaacacttgtagattcaatagaagatttagctttatctacaaatatattaatgaaagaaaatcattttcctacctatgatttagatacatataaacaatttgtaggaaatggtgttgataaattaatagagcgtgctttacctgaaaaatataaaaaagatgtgagaaaatatcgtgcacgttttgatgaaatttataaagaaaattgtttaaaacatacaaaaccttattcaggaatgaaagaattaattgatgaactttatcatcaagggtataaattagcagttgtaacgaataaaccaaaagtaaatgcagtaacaattgtaaatcatttatttcctaataaatttatgtatgttttcggaaatacggtttatcaaccaaaaaaaccacatccttgtttagtacaactagctatgcagttaatggaaagtaataaaaatgaaacattgatgattggtgatagtaatgtagatattgaaacagccatcaatgctaaaattaaatctatagggtgtgaatggggctttagaggaaaagaagaacttgttcaagctggagcaacttatactgtttctaaaccaagtgatattaaggacattctaaaatgattgcagtatcgagatgtttaattggtgaaaattgtacatatgctggaaagaataatctttgtaaggaaataaaggaactttatgatcaaggtttagcgttgccactttgtccagaagtcttaggtggtttaccaattcccagaacaccttgtgaagttactggggaaaaagtgattgatcaaaaaggaattgatcgtacaaaagaatatacacaaggtgctaaaattgctttagataaatgtttagaaaaaaatattaaaatagctgttttaaaagctaaaagtccaagctgtggaaaaaatcatatttatgatggaacattttcacatcaacttgttgaaggtgatggtatttttgtacagatgttaaaagaaaaaggaattgcagtttatagtgaaaatgaagtaacagaggttttaaaattaataaatggaggaaagtaaaaatgggacatattttatgggtagaacctgtatttaaagaaatgatttggggaggatgttagtaatgataccaccaaagttaagtgtgtcatcattcatgggatacttgaaagggaaattcgcattgatgatttttgatagacatgcaaacttgaaatataagtatggaaatagacatttttgggcagaagggtattatgtgagtacagtaggattaaatgatcaaaccgtcgcaaaatatataagagaacaagagtaacatgatattgcaatggataaattaagtgtgaaagaatatgatgatcttcaaccattattagtggtagatcaaatgattcatgataaatcaatgagaggaaatattggtttctttgtagatattggaacagaagctttctttaaagatttaaaaattacatactttgattaacaaagaatgtgattatcaattttttattaagtaaaggattaaataataaattgatgttaaaaagtgctattacaaaatgtattatcgttatagcctttttgtatactttaaaatcttatattatatgaattgataagatataaaaattagataaaaggaaaaatatttaattggttaaatgacatatatacataattttaataccgtagctgtcaaatagacgtatgttgttcattttttttgagagttaaaagaattaatattttcctctcattaaatgtacagaggcaataataatatcaattatatatttaatagaatattcattatatttattttctaatgaaggaacaataagcttttcatcgaagaagtttatagaaatatcatcattacaagtaattaaccaagttttgatattaagttttttaatttttgatataagctttttatcaagtctaaagattgtgccattagtagatacaacaattaataactttccttgagaaaaataagtgttttcaaaatcaatatcacaaataacaactgggataaataaagaactgaactttgtttgtatataattgcaaagaatcctattgtcaccttgagcataaagatatataacattactttgtaagatatcattaactaatttatttagaagagaattatttaaattggtagatatgtagtctatcatttttataatattggttgaaaataacttgatattatgtggcaagtcattttctttagaaaatattgtagttttttcatttatttgtttactataatctaagcatgcatctctaaactctaaatatgaattgtatcccaaattttttacacattttgatatttgcccttttgatgtatagcattttttagcgacatcttcaatcgttaaatgattaatgatatggatattagatttaatatatgcgcaaaatacatacatcgatgaagtaggggcatatttgtttaaaaattcattgattttatctacaagcataataactatttctccgttttagataaattatactcaaaaaaatctcattgtcattaaatacaatgagatttttataattactataacacgttaccattactttcaattacttttttgtaccagtaaaaagaatcttttttatatcttttccatgttccctgaccataatcgtctgcatctacatatatataaccgtaacgtttacttctttcagaagttccagcactaacaatatcaatacatccccatgaggtgtatccaataacgggtataccttcgtcaatacatttaccgatttggtcaatatgttcctttaagtactttattctataatcatcgtgtatttttttatctgatgtaaggatatcatatgtaccaagaccattttctgtaataaaaattggtttacgatatctatcccaaatttcattgattgctattctaagtccaataggatcaatctgaaatccccaatctgtaatttctaatgaattgtttcttattttttcaggatgaaattcatcatatcttttttgttcaggaaggaaggcaagaattttatcctttttattaattttttcaccggtacaattactgtagtagtaactaaatgaattgaaatcaactgtatttttatttattatttctaaatcatcatattctattttaatattgatcttattttttctaaaatatttttttgcataagaagggtatattccttttgataatacatcaaagaaaaaataattgattctatttgcattttgtgtcaataagacatcttttggagaatttgtatatggataaaataatgacatacctaccatagatccaattttgaaatttggatttattttttttgaaatttttttaactaaggcacttgcaacaaattgatgatgtaacgcttgaaaagttgcactatttggattgcatgttttttcaatgaatattgcagcaccagaatagggaacgtttaatgacatatttatttcattgaacgcaatccaatactttactttatctttgtaccttgttaaacacgttttagcatattttataaataaatctattaattctctgctttgccaaccattatattttaatgctaaatttaaaggggtttcgtaatgtgatagtgttactaagggttcgatgttatatttcaataattcattaaacacattgtcataaaattttaatccttcttcattcggtactttttcttcaccagtaggataaattctaggccaactaatcgacattctaaaacatttaaatcccatctcggccattaaagcaatatcttctttataatgctcataaaaatgagaaccttcacgtttaggataatattcatttttgtgtaagccatgcaatatttcattaacggtttggtaggaaacaacttctgtatttttgcctttactaatattttttggtacaaattttaccatatcagctgtacttagccctttgccatctaaattataaccgccttctaattgattggcggcagttgccccaccccataaaaaattttttgggaatgtactcattatttattttcctccttttctagcgtttgtttgttagccatattgacaaaaggaagatagattagtacacaaattataaatacaataataacggaaagtgcggttcctaatgagccacccgcggataagaatgctttgattggttgaggtgttgtccatccaacgtctaatgttccgggcaaaacgataccagatgatattaatagagcaccaattcccatagaaataaggggcgacaaaataaaaggaactattagtattggatttaaaacaattggcattccaaagataattggttcatttatacaaaataatccgggaattagagataacttggccgtcttagtataatcgtctcttttccagttgcttttttttgacaagattaatatagcaacaattaaagctaaggtgtttcctgttccaccaatgcagccatagttttcaaatagtgtaaaccatgtgattggataaggtgagccggcaactgttcctgcttgagcagcatattgcaaattagcaacatttaatgcagaatataatgcaacatgaataggttgaacggtaaatgttccatgaataccaactgaccaaagaatcatagcaataagtattaaaatcaatggtgttattggagaggtacctatcaattgaataggagattttaatatattatataatagtgtattaattccttctggttcaaaaaaatgaataatgtaagcagctattgcaaacataaaaataataattgaggaaggaataactactctaaacgaatttgcaacttctggtggtacttgagctggcattttaatatgtaattttttatttttagataatttgctaaataaatacccaactagtagaccaataaaaattgctacaaataatccatttgctcctagataggaatctgttagcatattatctgttttaggaggatataaagtaaaaaatacagcaagggcagttagaccagcttttgtttcatcttcatgatgttgtcgagccatgttttttgctatcaaaaatacaatgaaaatagccataatattaattgttccattttgaataggagataaaatatcttgatatttatctaattctggaatgacagaaattaataattgtccaataaatcctgttgaattaaagactacacaatttatgcatactgctattgatccaacaaatgttaaaggaaaaatttgtataaatgcatctctaattgcaattaatccttttatattattaagtttaactgcaaaaggaataaagtgcttttcaaaaaagtcatttaattttttcatagttatcaccatctttctattattttttatttattagatgaatattatcattaaaagagatgaaatcatgataatacacataaaataaataaaagtgtaaaagtatctctttatgcttaaagtatatataggaatacttgtaaattcaaaaaagtttccataataggaaacttttttaatgcaacgaatattcaagttatcttattatcttttccatatcaaaaggaagtaaacattcaatttttattgtttgataagttaatggatgaataaactccaaacaataagcatgtaaagccattcttttaatcatagaagaagtttttccataaagagtatctcctataataggatgatgtaaatgattcaaatgaactcttatttgatgttttcgaccagtttcaatttgacattttacaagtgtataatttccttttgttttaatttctttaaaatgtgttaaagcatctttacctgttttagaaatacacattttatttttactatgacggtcttgaccgataggtaaatcaatagtcatttctcttttaggtaaatgtccttgaatgattgctagataagttttcttaatttttttagatgcaatcatataatcaaaatagggttgtaaaagagcacatttacaaaacatcacaagaccggtcgtatctctatctaaacgatggagataacgaattggtaaatcttgatgagtttgttggtagtaataactcacataattacaaagagtattttttttacttttatcatcaggatgaataatgaggttgcttggtttattgacgatacaaagcaagtcatcttcatagatgatatctaaggaactttcttcttcgataaaatctctgccttgttcataggctttaattgaaagaatatctttatcttttaaaatggtttgataatcaacataagtattatttaaagtatagtctttattttgacgaagtaagtgaattgtttttttagaaagatgcagataatgaaagaattcaagaagtgtcattcctttaattctttcattgatttctattactaaatgattcttttttttatgataatgcatacactgttactttgatatcaattgtgatatctaaaccttgtaaagtatctaaaacgccacgtttttcttttttaatatgataatagtgtggtgtcatcattaaaagatttaaagcatcttcacgattagaaatatgaactttttctttaaagtcataacttttcacttgattaaaatctaaacgaatatacttatcactttttactttaatttcatcataaatcaattctttaatttcaattaaatgttgattattagcagtaacatgaataatataaccatcttctttaagtgctctttttaattcatcttgatttactactgtaaataaagcacagataaaatctaaactatgatctagaataggaatatttttagaatttcctacaagccaagtaacatctttacgataacgtgttgccatatcaatagcaatcttggaaatatctaaaccatagatatcactgttttcaaaatgtttctttaaaccttgagtataatatccttctccacatcctaaatctaaaatacttaaatcatcttgatgtttgaattcatcaatacacgtaatcacttgatttaagataggatcataataacctttatttaaatatgcttttcttgcgacaagagattctttactatctcctggattattggtagctttatcaggatttaataacaaattgatatatcctcttttagaaatgtcataacagtgattattttcacattttagtgttttgttttctaaatgaagttgttgatgacatttgggacaagctaataatttcatagtatcacctcgaatgtattataacaaaagacaatctaaaaattaactgaatttatgatgaatttgtgatactattaagggcaagggaggaatgcttgatgttttttagaaagaaacaaaaagtagacttagatgctaagtttaaagaagtatatcatgaagtaaataaaattacagctgatgccggaaatgaattagatgtgaccatcaaatattcacaattgaaattggcttgtcgtaagtatgatgaattgattgatttaattcatcaaggagctaattttgaagaaaaacattttctttctttaaaagaaagtgtagaagaagaaacaaagagagtagaaggtttattagatgaagattaaagcatataagaaggattttgattatacctatactttaggagtttttgaaacgattgagttattaaaaaatcgacctgatcttgttttaagagtatatataaaaagtaattcttataagaataaaggaattcctattattgatgaaatttgtagagaaaaacatattgaattgattgaaagtgataatacaattcaaaaattatcaaaaaaagataattgttttgcgatagcaatcattaaaaaatatgaaatgactttacaagagggaaatcatgttgttttagttaatcctggagatatgggaaatatggggacaattatgagaacgatgttaggattcaattattataatctagcaataattcgaccaggtgtcgatgtttttgatcctcgtgttttaagagcttcgatgggagcaatgtttcatttgaatattgagtattttgatagttttgaagattatttaaaaagatttccaagtcatgatatttatacattgatgttaaaaggagcaacgaatattcataaggttgaatccaaagaaggttatcattcacttgtttttggtaatgaaagtagtggtttacctgatgaatatctagattatggaaaatctatttttattcctcatagtcatcatatagattcattgaatctttccatggctttaggaatgacgttgatgcatttttcaaaagatgaatttaaagataaagaagtattataggagggaaagtatgtttgattttgatgaagttgtagatagaaaaggtacaaattgtgctaaatgggatacgattgaagcaaagaataaacctaaagatgtgttacctatgtgggttgcagatatggattttaaatcaccaaaggaaattgaaaatgctttagttaaaagaattaaacaaggcgtttatgggtattcatttgcgccagatgagtattttgatgcggttatttcttggatgaaaagaagacatgattttcatgtcgataaagaatggatcatcccaacaccaggtgtggtaacagctattaaattatgtgtaaatgcttatacaaaggaaaatgatgccatcattattaataagcctgtatattatccatttgatttttcaattgaattaaatcatcgtaaaatcattgaaaatgaaatggtttataaagatggttcttatgaaatggattatgatgcttttgaaaaagcaatcgtagaaaatgatgttaaaatgtttattttatgtaatccatataacccaattggaaaagtatggaaagaagatgaattaaaacaaattggtgaaatttgtaagaagcatcatgttttagttattgttgatgaaattcatgaagattttgtttatggagatcatgtacatattcctttctataatgtagatgaaagttataaagaattctctgttattttaaatgcaccatcaaaaacatttaatttagcagggttacaaacatcaaatattattattgcagatgaaaaattaagaaaagcttatcaagaaacaatgaatcgttatggggttaatgaaccaaactttttaggtattattgcttgtatgactgcctataatgaatgtgaattatgggtagatgaaatgttggaatatgtttatgacaactttacttattttgatgaattcttaaaagaaaacttacctcatattcatttagtaaaacctgaagggctttatttatgttgggttgattttagagaatgtggtttagataaagatgaacttgaaaagacaatgttagaaaaagccggtttatggttagatgaaggatatatctttggaacaggtggagaaggttttgaaagatttaatcttgcaattccaagaagtgttttagaagatgcttgtcaaagattattaaaagcttttggaaaataaggtttttatgataaaaactatggaaattctatataaaagatagtattatataaccgaaaaaaagaaaaggagatttgttatgggattagtatcagcaacagaaatgttaaagaaagctaaagaaggacattatgcagtaggtcaattcaatatcaacaacttagaatggactaaatcagtattattaactgcagaagaattaaaagcgccagtaatcttaggtgtttcagaaggtgctgctaaatatatgactggatatacaacagttgcagcaatggttaaagcaatggtagaagcattaaatatcactgtaccagtagctttacatttagatcatggttcatacgaaggagctaaagctgctttagatgcaggtttctcttcaatcatgtttgatggttctcattatggaatcgaagaaaacatcgaaaaaacaaaagaaatcgttgaattatgtcattcaaaaggtgtttcagtagaagcagaagttggatcaatcggtggagaagaagatggtgtcatcggtaaaggtgaagtagctgatccaaaagaatgtagatcaatcgcagatttaggagtagatttcttagctgcaggtatcggaaatattcatggtaaatacccagcaaactgggaaggattagactttgatgcattagatgcaatccaagctgaaactggaaaattaccattagtattacatggtggttcaggaattcctgatgaaatgatcaaaaaagcaatcactttaggagtatctaaagtaaacgtaaacactgaatgtcaattatatttccaagaagctacacgtaaatacattgaagctggaaaagatttagaaggaaaaggatatgatcctcgtaaattattagcaccaggtgcagaagctatcaaacaatgtgttaaagatagaatggaagtatttggttgtatcggtaaagcttaatcaaataaaaaaagccttcgggctttttttgtttatgtgaaatctctttattaagttgtttttttaatgaatttataatatagtattagggaatatagatagaagaaaagaggtaaagtcatgagtgaaattattgcgattgaaggcggacataaattaaatggtacagtagaaatctcgggtgcaaaaaatgccactgtagcacttattccagcaattattttagcggatagtcctgtaacgatttatggtgtaccagaaatcagcgatgtggacgctttagcagttttattagaagaacttaattgtacagtattaagaagtcatgatagtttaattgttgatccctctcgtatggaaaatgttccattagtgtcagatgccgttgataagttaagagcatcatattatttaatgggagcattacttggaaaatgtaaaaaagttgtgatgaaagcaccaggaggatgctttttaggaccacgtccgatagatttacatattaaaggatttgaagcactaggtgccaaagtagaatttgttgatggtgcgcatgtgattacagcagatcgtttagtaggtgcaaaaatatatttagattttgcttcagtaggagcaacaatcaatatcttacttgcagcagttaaagctgaaggtagaacagtaatcgaaaatgcagcaaaagaaccagaaatcattgatgtagtaaacttacttacaaaaatgggagctaaaattagaggtgctggtactgatacgattacgattgaaggagtagaacatctaaaaggatgtactcatgaaatcattccagatcgtattgaagcagggacattcttaattatggcagcagctgcaggagaaagagttattattcaaaatatcattccacaacatttggaatcacttatttcaaaattgaaagaaatgggagtgaagatggaaaatgttggtgatagtattattgtttatggtgataacaagaactttaatgcagtcgatgtcagaacacaggtatatccaggttttgcgacagatctacaacagccattaacagcactgcttacacaagcaaacggacaatcacaagtaatagaaacaatttatccagagagatttagacattgtgaacaacttaataagatgggcgcaaatatagaattagatgaatcaatgtgttatataaatggaaaaacaccattaaaaggagcaaaagtagaagcaacagatttaagatgcggagcagcattgttaatagcagggttaatcgctgatggaattacagaaattagcaatgtatatcatatagatagaggatatgcaaatattgatcaaaaactaattactttaggtgctgttattagaagaatcaaagttgatgattaggtgttaactaagcaaaattatatttatgtaaaatgaattatcttgtaaaatagtacaaaaattgtctatatctatggatttattgatatggataagactaaactagtcataattgtattaaaattatatttatgtaaaataaaagatatgtgatttttttataaaaaattaagaaaatgagttaaaactaatcataattattagataaataattagactaaataaaactaaataaaattataaaaaagggcttgaaaacaacataatttaatgttaatatatcatagcaacttactttgtagtgagaaatctacaaggcggaaggagaaataacaatgaaaaaaggaattcatccaaattacaaaaaagtaaaagtagtttgtacatcatgtggagcagaatttgaaagtggttcagtattagatgaagtacgtgttgatacttgttctaactgtcatccattctatactggaaaacaaagatttgctagtgctgatggacgtgttgaaaaattcaacaaaaaatacggacttaaataagaaaatgagtacttggtactcatttttgttttggaggaaaaaatgaaatatcatgtcttagcaagtggttctaaaggaaacagtattttcatttatgatcaaggaaacggacttttaattgattgtggaattagtaaaagacaactttatacaaaacttaatcaattaggatttcatgaaagtgatattcatcatgttttattaacacatgatcatattgaccataataaaaatattggtatctttgatcaaagtattgtttattgtggaaaaggatgcatccctggtatagatgaaagtcatgaattagaaaattatcaaaatatacaattagatcattatataattacaccattacctttatcacatgatgcaacatcccctttagggtttgtaatcaaaggaaaagatgaaacaattctctatatgacagatacaggttatgtttcacaaaagaatatggaatatataaaaaatttagattactatatttttgaaagtaatcatgatattgagatgttaatgaatacaagaagacctttatttttaaaaaatcgtatttttggagataagggccatcttaataatgaatatagtgcacatgttatggcgcaggtgattggtgaaaatacaaaagaaatttgtttggcccatttatcacaagaagctaatacaaaagaaatggcattggatacatatcaaagagtttttgacgaagaacatatatattttgataatataaagatcgcagatcaaaaagaaattgtttctggaggacattatgaaaattagaatcttaacaattggtaagcttaaagaaaaatatcttgttaatggaatcaatgaatatgtcaaaagattaaatgcttactgtaaagtggaattggttgaagtaccagatgaaccaattcctgataatgcaagtgaaaatgtagaaaatatcatcaaagataaagaagcagataaaattgtttctaaaattaaagatgatgaatatgttatcgttttagatctacatggaaaagaaattgatagtgtagctttttctaaacatattgaagaatgtatgattaaaggaaagagtacgattacttttgtgattggaggttctttaggtttaggaaaatctttattacaaagagcagattatcgtttatgtttctctaaaatgacttttccacatcaattaatgaagcttatcttagttgaacaagtctatcgagcattcaaaattatgaacaatcaaacgtaccataagtagcctaggttttttacaaatacttattgaagataagaatataatgaataaagctcagtggattcatagtgaattagatgggtttttatggttaaaaataatttatgttgtaggtataatctttatagaattgaaaagggatgaggttaaaaatgttaataagtgataagttaaagtcttttgattttacgtatgcagaaaaagaaatagtaaagtattttttgaatcaaaaggaagaaattgcaagacaatcaacacgtgaaatatcaaagagattgtattgttcgccatcatcaataatacgactttgtcaaaaattaggatttactggatttgaagaatttaaagaaatgtatgtcgaagaacttcactatttaaattcgaatttttcagatataaaccccagtataccttttatgacagaagataacatacaaacaatatcaaataaaatgtgttcattgtatcatgaaataattgatgacacacattcactattggatcacgatatgttaagaaaatcattgaatttattaaaaaacaataaaaatatttatattatttcttctggatcgcaaaatgatcttgctttaacttttagagataaaatggctagaataggaaaacatgtaaatgtatatcaaagtatcgatgaaccatattatgaggcttgttatttaaataaaggagatgcctgttttcttttaattagctatacaggtgaaacacaaaattgtataagaatggcgaataaattaaatgaaagaaatatcgattttattactattacatcatttggaacgaatactttatcttctttatcacgttgtgttctacatgtttctacaagagaaaaaattagaaacaatttgggaactttttctatgaatttatcaacactttatttgttagatttattgtatagtatgtattttagcttaaattataaagaaaataaaaagaaaaaaattaagattgctgatgaatatgaaaattttacatcgtcacttataagagatacaagcaatgatttaatcaaatagggaacagtgttctctatttttgtttgaattatgtttgttttgttggaacagtgtaactataaaattcctctttattgatttaagaaaagtataaaactagaatagttttgtaaaaataaggaggatataaaaatgagtaaaaaacctgtaaaaattgtaacaattggtggaggatgttagtaatgataccaccaaagttaagtgtgtcatcattcatgggatacttgaagggaaaatcagcattgatgatttttgatagacatgcaaatttgaaatataagtatggaaatagacatttttgggtagaagggtattatgtgagtacagtaggattaaatgattaaacggtcgcaaaatatataagagaacaagagcaacatgatattgcaatggataaattaagtgtgaaagaatataagaatccgtttgaagaaaaaggaattcgagaagaaaatagaagccgcaggaaaaagcaaaataaaaattccctttgagggaaagcgagagtcaaaagcgatagcttgaacgaagtgaaagcagcgcctttagacgcgagcaagtaacaaaggcttatagccacagtgaaaaccacgccgttttgaaccgcccctgtcaagtagacaggtaaaataattaaaattatgtatgcattattgacaaaccccattcctaccaattgactggtaggaatatttttatgtgatgcataatgttctttcttgtatcttgatatccttttattttctggtattggatattgatttgactttggtatctagcattaaaatatagtgatagtaaaaaagcagtaggaattcaagatagaatctttattgctttttcgtttaaatcttataattgaatatctgtctaatttgccgctctgtcaaatagtaatttgtaagtggaagatttgtaatcttttcaaattcttttataaagtcacttgatgccgttacattgatatatttactttcacctttgaccaccttaaagcttctaatgaatttcataatttgatgtgtgctgtattgattatccaatatcttaaactggaatattctttctaacagtacggcaagataacagatcaggaagtgtccctttatgctgttttctttttgaagaaatacagggcgtgcatctaaatcagacttcattattctgaaggattcttctatcctccatagattgtgatatgtattatagatatcaatatcatccatatccttttctgaagtaacaagcatattgtatcctgcaaactttagctctttttcaatcattgattcgtttattgaggccttggctttctctccgtcttcatcaatgaaatcgacatactttcctaaatctccatattctgatcgttttgcctgactgtaacagaggtttcttgctttttcaatctgtttgactatttcatattttttctttgaggccagttttggattataggtaacaagtcttttttctgtaaagcagagggttttctttttaccatctatttcaaaagtgtatggaaatttttcgacacatgatttatatctgtataacagtgtgccatctctgcttcttacatccttccaatcatcattatccaacagtacccatgtcttttctttttcaggtaaggattttactgattttgagaagagatagccatctccgttttctttggaaaaggcgatattctgtgcacagttcaatcctttatctgcaacatggatggttttccctgtgatttgatttttatccttcagttttttgatgacatttctcagtatgggcttttcactttcgttgccaggaaatagttccatgccaataggaatttgattagcatcaagaagcagtcctaagccgacaatgggatcttttctgttttctttagaaggaccttttcttctaaagtcatcttctctgtctatttcaaaataaaaattactgcagtcaaagtaggtcttggaagtattgatatcatagaatttctttgtctgttcattaaagatttcgataaacttgccgtagtcattgccgatgaattcaagaccatcaagaagctgatcataagaaaagtgaacgccgtctcttagttgaggaaggacctcatgaaaagttctatgcttactgcatggattaacaagacgagcatagataagagatgaaagaagttcgtaaaggtcaaactcaaaagaattatgcagattgaaatagtcgacatactttttgatatccattttattcatcatggatatgaatggaaaatatccaagatagagttcaggagaatgatcggaaatcttaagagaattcttgtttttattatttttgttgagttcatccacttctttttgaaaataggcaataggatcatcaatacctttggctttccaagtttcaacagaagcaagtgatttataggtgcgatgagcaccaccatgcttttgaggggagtaataactttcaacgatggaaagataggtacgacctttaagagtagattttttaaggaaaaaagccatagaaacacctccaataatatatcactactatcactatataaattataacataaaaaataatataaaaaaattaaaagtataaaaaaagccgataaaatcgacatattgaaagaaatggtttaaatgtagttctaaaaaatatagtgataacttctaaagacgggtttttttgattccttttttgaatcattgtttgaacagccggtaatacaaaaaagacatgtaattgtagaaataaaaaaaataaataatttttttattttcataaaatgccccctttgcttattcatcatttattatatcatattcaaaggaagtttgtcataaatagaaagctgatgtacaataataaagaaatgaggtgattatcatcgcaaattcagggaaaagatgtttatgtagatgtataaagtcaatgaacatcattattggaaaagaagaaaatactttatttgaaaaaggagcaatctatgattgtgttattaaaggagaaataaatgaacaactttattataaagtatatggtgatgagttcactttatcttgtacagaaaaagaattccatcaaaattttttgattatcaaacataaaaagacgaatgaaggaaagtaggaattttgaattttataagaagtatgataaaataagttgcataaaaaggagtaaagaatatggaacgtgtatattatattgatcatgtaagtaatgatgatattaatgctttatctttaaagttaaatagtatgcaagaagtgtcacatattaaaataaataaggattctatttcgtttaattgtgcacgaccagataatatacaaaactatttagatgaatcaaagatggattatgtacttcaagaaatggtcaatcgaaagaaaagagagtatgtttctaatcaagcaaaagtagaaaaaatcttcatgtttacgaatttggaaagtgaaaaagatgcacacgaaatacaaaacattctttctaaatatagtgtttatgaaaatgttcaattagattttcaaaacaaacttttaacattaacaacttcagcaaaagcattacctcgtatttcacgtattgttgaaaatgttaatcctgaaatacaagtagaacaatggaaaaagccttttaaatcacaagatttatttaatgaaaaatatgtacaaaagtatgcaagaattgctttattatgtgtaggtattgcacttggattggttacttttggagatacttcatttttaacttatgtaggatggatgatagctttacttatttgtaatgaaaaagtacttgttgaagctaaaagagatttacagttaaaaaattatttatcagaaaataatatctttttattagcttgttttatgggatggatctatggagcatttattgaagcgttggttgtttctatcatgtatcaagctggtaaacaattgattatgcaagtaacacaatggtctatggaaaagatcgatgatttagtagcgcatcaaaacttaggaagaaggttacgtaaaggaaaagaagaaatgattcctttaggtaactttgatattggagatgttatcgttatcaatgagggtgaaaccattcctttaggtggtaaaattattaagggaaatgctaaattggatgtttatgccattgatggtagtgatgtatgtattaaatctaaaattggaaatgaagtttatagtggaactgttgttacagaaggatatttacatgtaaaaacaacagctttatatgaagattcagcaatgtctaaagttttagatattgcgatgaatgcaccaatgtcttcatcacatacagaaaaaattatttttaaagtttctgatgtttattctaaagctttaattattgttggtttagtatgctgtgttgttttaccattaataaatttaacagataatttaaaatatatgtatttaggaattattatgttgactgtttctggaagttttgcctatgttcaaggagcatcctttactttacttgcgggaatagctaaagcattctctaaaaaaattgcgattaaagaaaatagcgggttggatgatttaaatacatgtacaacaattatctatgatcgttttgatggtattgaaacaacagaagaagaaatggatctttttgaaaaaatcaaaggattacataaatcattgattatttttaatgacggaccggttgatttagaaaatgatgaatatacaatttataacaattatagtgttgaacaaaaattaaaagttatggataaaacacttgttgctggacctgttgcttatattggagattgtgataaagatattgctttacttcaaaaggcttctgttgccatttctcgtggtggtgtgcataatgaaaaagtacaacgtaatagtgatattatgttgacggattctaattttgatacaattattgatttattaaaaatagctagaaaacaaaagagtattaatattggaaatacttttattgggattgtgattagcttgcttgttgtattattagcagttatttcatttatttcttggtgggtagcttgtttaatttatattttagaatcaatacttgttttattgaattcacaaaatattgtaagaatgtaaaatgcaaagatttctttgcatttttttaggagaaaaaaatgaaagtaaaaaaagaaatgttattaatggattatctgttattatcttataatcgcaaaaatgctaaaaacttattaaaatataaacaagtttatgtaaataaccaacaaattagtcaatttgattatttattacatgaaaatgaccaagtagaaatcaaaaaagaaaatacatcttcattagagattctatatgaagatcaagaatttgttgtaatcaataaaccttctggtttattaagcatgtcagatggtaaagaaaaagaaaaaacagcttatcattatgtaagtgaatatttaaaaaaacaagacagaaaacaaaaagtatttattgttcatcgtttagatcgagaaacatctggtgttttaatgttttgtaaaaatgaaaaaataagagatttattacaaaaagattggaataaaattgtttatttaagaggctatatggctttagtagaaggtaaaggcttaaaaaatggaacattaaaaaactatttggcagaaagtagaagtcaacaagtttatgttacaagtaaagaaaaagggaaacttgcgattacgcattataaagctattaaagaaataaaaaaccaaacccttttagaaatacaattagatacaggtagaaaaaatcaaatcagagttcaattatcaaatattcatcatccaattgtgggcgataagaaatatggagcaacaacgaatccactgagaaggcttgggttacatgctcatgcatttggttttattcatcctgttactaaaaagaaatatgaatttaaggtggattgtccaaaagaattttatggtaaaaaataagaggtgaagaaaatggaatctatgattgagtttgtacatcaaaggataaaaaaacataaatatcaaaacgggattgattttacgatgggaaatggtcatgatacactgtttttaagtgattattgtcatcatgtttatagttatgatattcaatcattagcgttaaataatacaaaagaattagtaaagagaaaaaagaatattactttatttttaaaaagtcatgaatattttgatgaagatgttcaagattttgaggttggaatttttaatctaggttatttaccaggtggcaatcatgaatgtgtaacacagtatgaaacaaccttaaaaacaatagaaaaagctttggaacatttagtcaaaggtggatgtttgcatgtggttgtttatattggacatgatcaagggaaagaaagtacaaatttggatgcatattttcgttctttagatcataaactatataatgtagcaaagtttgagatgatgaataaaaacaattcgccatatgttgttattattgaaaaaaggtaaatcaaatcagtaaaaacgtgctataataaatatatagaaaaggggagattattatggcaaaaaaagtgaatattgaaattacaaatcctgtaggtctttatgcttctccagctactgaattagtggatgcggtcaaactttataaaagtcatgtgacgctcaattataatgaaaaatcagtaaatatgaagtctttaatgggtgttttgtctcttggaattcctcataaggcaaaaattgaaattgttgtagaaggtgaagatgaaggtacagcaatggatatgattgttgaaaaaatcaaatcacttgaaattggaacgattcaataataaaaatacgcaaaagcgtatttttattttatctttttaatattcatatctttaggtaaaacaagacttagaataattgaaacaacaaaaacaacagcaacgcaatttccagcaaaaacatcttgaatgatttgtggaaaaatatgccaaatatcagcttctgttcctgaagtaaatccaattccaacagctaatgataaagcaacaattgttacatttctttgattaaatccagctttagcaatcatttcaattccacttgtaagaatagtaccaaacatcataattgtaccaccacctaaaacagattcaggcaatgatgaaaagaaattaccaataggtggaagtaaaccaactaagatcatacaaatagctcctgtagcaatcgtaaaacgattgacgacttttgttatattgattaaaccaacattttgactaaaagaagtaatcggtggacaaccaaataatgatgaaatagaactacaaaacccatcacaagctaaagaatcagaaatttcttcttctgtaactttacgatttaatcctgagtttacaaggactgaggtatcaccaatcgtttcagtagcagaaactaagaaaataacgacgacagcgataatcgcgccaagatcaaacttcattttaaaaggaagtagatgagataaagcaatcaatccaccattaaaaataacagataaatctacttttcccataaaaatagcaagaatattgccaacaattaaataaaataaaacagataattgttggctatatgattttgcaaaaatattaaataataaacaagttgctaaagtgataatccctaaaagtaaatttttagcagagccaaaactttcactgtaacctccaccaaaagaacgtgttccaacagaaaaaagtgaaaaatcaatggacgtaacaacagatgcagcaacgattggtgtaataattttttttcaataacgtgcaagtagtcctaaacacccttcaattagtccacctattaaaactgcatccatggcacttgcataaccataagtagcacctacataggttaagatagctacaaaattaaagctgacactcataacaataggtaaacgtgaaccgattttccaaataggatataattgaattaaagttacaattcctgcaataaacattgcattttgtaataaaaatgcaatttctgtttgttttaaactagatgcaagaccaattaaagtaattggtgaaaggttagcaacaaacattgctaagatatgcttcaatccaaaaagaattgcttttaaaattggaactttaccatctaatttgtaaagattttccatacttgtgttgttttctcttataattttccccttattaataaaaataaaaataagtgaattctaacgtgtttttataagaaaaacgataattttcaaaaaaagagaacgttttttttagaaatttgaaggagataaaaaagtgtggtatagtgtaaaagaaataaagagtgaaggggaatgaagtttatggaaaactttataaagttaatgttggcatttggtattggacttttattagttttacttgcaatgcctaaagtcatcccatttctacataaaatgaaatttggacaagtagaaagagaagagggattagaatcacataagaaaaaaggtggaacacctacaatgggtggtgttgtttttgttttagcggcagtgattgcagcgtttgttgtaaattataaaaatataacaaatcctaatttgattttaattacaattgttttagtaggttatagtttaattggatttattgatgatgctttaattattttaaaacatcaaaatgaaggattgaaagcatggcaaaaattcttgatgcaagctattttggcagtaggatgttatttgtatttagaaaattttgtacctggttttacaacagaagtgactattccaattgtgaaagtaaatattgattttggttggttctatgctgttttagtatttattatgtttaccggtgaaagtaatggtgttaatttatctgatggtttggatggtcttgcgacaggtctttcaatggttgcaattgcaccatttatcatctatgctattatgattaaagattatacgattgcaagttatgctacagcaatggttggagcattacttggatttatgtattttaactatcatcctgcacgtatttttatgggagatgtaggttctcttggacttggtggatttttagctattttagcaatcctaacaaaacaagaattattgttaattgttgttggtggtgtcttcttaatggaaactttatcagtaattattcaagttgtttcttttaaaacaagaggaaaacgtgtctttaaaatggcaccaattcatcatcattttgaaatgttaggttggtctgaacaacaagtaacgatttcattttggtttattggatttatttgtggtattatcgctattgtgataggagttatgtaaaatgttaacagggaaaaaggttttagtgattggtcttgctagaagtggtaaggcagcagttaagttattacaaaagttaaatgcaacaattacaatcaatgaaggaaaagaattagaaaagattgaaggatatcaagcatatttagatgcaggaattgaaattgtagcagggggacatcctgatgagctttttgaaagagactttgattttgttgttaaaaatccaggaattaattatcataaaccttttattttaagattaaaagaaagaggtattcctgtttatacagaaattgagttagcatatcaagtagctaagaaacaacattatattgctgttacaggtacaaatggtaaaacaacaactgttactttgatttatgaaatattaaaagcacaatatgaacatgttcattttgcgggtaatattggtaaacctttatgtgatgttgttttagaaaataatttattagaagaagaaaatcattatattgttattgaaatgtctaatttccaattactagatattgataaatttagaccagaaatttcaactgttattaatttaacaccagatcatttagattatatggcttcattagatgaatattatgcttctaagatgcgtatttatgaaaattgtgaaagtgatgatgaagtttttgttaataatattgatgatgaaactttacaagaatatttacaaagatatcatgtttattgttgtgttttaacacaatctttaaataagccagctgattgtagcattattgatcaagcgatttattttagaggggaacatattattgatttaaaggatattaagattgtaggagatcataatgtccaaaatattatgattgcgactactatttgtttagttgctggagtaagtcctcgagtgattaaagatgttgtgagtcattttaaaggggttgaacatcgtattgaattcgttagagaatataatggtgttagagtttataatgattctaaagcaacaaatacagatgcaagtattattgctttaaaagcttttaaacaaccagttattctattaatgggtggttttgataaaggattagacttacaagaaatgtctacttataattcatgtattaaaaagctcgtgacttttggagcagcaggtaaacgttttaaagaagatatgcatcatcaagatgcttattatgaaaaaactttaaaagatgctgttaataaagcatttgaaataagtgaaccaggagatatcatcttactttctccatcaacaagttcatttgatgaattcaagggttatgaagaaagaggaagaattttcaaacaatatgtaaatgaaaaataagagagtacaaagcatactctcttttttaatgaataatttttaaaacatcttcttcactattgatgttaaaggtatttaatgtaagttcattcaatttttctagcgatgttgttgtaagtctttcttctaaaggatttgataaagttcctagttttattttaagttgctcttttaaagtattgagttttccttcatctctcattctttgaaataattgatcctggattgtcaatactttttttaatattgatgtaaggagttttcttgatttaattgtatcatatgcttaaagataattcgtctcatatttgtttcacatttaattcacaaatatttcttttttattattttgtctttctcttttccttctttcaatggacggatagtccaaaaaaagaagtcccttaggacttcttgaaatacgtttatcaagttttacttttttaacaatctttctactaaatcatcattcacgatttcatatccatcaaaataataatcatacaatccttgaccttgagtaatagaacgtaaatcaatcgcaaattctaatatttctacttgaggaatacgacaaacaagtttgattaaaccatcgtctaaactatcagtttcaaggactttaccacgttttttattaacatgtgacatcaaatcacctaaatattcttcatcaatataaatatttaaaatgacataaggttctaataaacatggatcaagatgtttcattgcttctttaaaacacatcatagttgctgttttaaaagcttgttcacttgaatctacactatgataagaaccatctaataaagtagcttgtatacctaaaacaggataatgaccaataactccttctttaacactttcaatcaatcctttttcaacagcagggaaataagcttttgggacagccccaccaaatactttttctttaaatatataagattgactataatcttttgttggttcaaaaagaatttctacttcaccatattgaccatgaccacctgattgttttttaaactttgtacgttgagtataacttttacgaattgtttcacgataagaaactttcatatcacttaatttaacatcaattttaaatttagattttaatttagcaacaacactttctaaatgaatatctccaataccataaatacattgttgttttgtttcatgattattttcaaattttagagtttggtcttcttctaataatcttgtaataccactagcaatcttttcttcatttgctttaccaataggttgaatagctttaccataatatggtttagaaaaatgaatagattggtatttcatacgataatctaatgtacataaagtatcatttgttgaagaatgagaaagctttgtcatacatccaatatcaccagcacataattcatcaacttcaataagttcttttcctctttttatgtaaagtttattcactttttcaacttcatttttattgacatttaataaagacattcctgtttgaatatgacctgtacagactttaaaaagtgattctcttcctacaaaaggatcaacaattgttttaaaaatgaataaagaaggtggtagactttcgttaaaaccgatgatatcttcttcatgtgtatcaatattttctacaatgatagaattacatgtatcacctgcagcagggaagaaagcaaccattgaatttaataaaatttgaataccaatattacttgttccacataaaacaggaatcaatgtttgattcataactccttgacgtaaagcccaagaaatttcttctttagtaaaaggttcttcatttagaaatttttctaataaatcatcatttgtattagcgacagcttcatcaatcatttctttgacaggcataacttcatccatcatatcttcaggaatagggaaaggttctgtatgttctcctttaaaaatacgaccttccattttagctacgttaatataacctatcattttatcatgatccatgataggaacttgaattggtgcaattcctttaccataggctttttttaattgatttaatttttctttataattggcatctggattatctaagccattaatataaataattttagctttatcttttgctctaaacatggcttgctttgtaccaatactgatatccttataagaaggaacaacaatgacagctgattctgcaacgtgtaaagcagcttctacttctcctacataatcaaaattaccaggagtatctaataaattaattttacaatgatcccattctaagggaataagtgataaattaattgaagattgacgtttaatttcttcaacgtcatagtcagaaatagttgttccttgactaatagttcctatttgttgagaaattcctgcacgttttgccatggcttcaataatgcttgtttttcctgaaccaagatgtcctaaaacagctacatttccaatattatttgagtgatataaattcatagacattcccctttcttatataactatttatattatacaatgatttctttatataagaaagcggttacaacaaaaaaagaataaccttagttattctctaaaatatcttgtattgttttttgatttcctttgatttgtccttgaaccatatttgctttaccgccgcctttgatttcaaagtgaccttttaacttatttaaaagctctctagagtcattgttacttgcaatcataaaacgataattatcatcttttcctacaaaaatagctacataattagaacacaatggaaataattgatttaaataatattgttgtaaagaacgatctagatcattagtaaaaattaaataatgatcttgctgaggcaatgattgtacttgttgatcaattatttgtttttttaagtttgaaagttcttgttttaattgattgttttcgtttaaaagttgatcaataccttttacaaggtcatcaggtggtaatgaaagcttttgagaaatatttattgcttgtatgtgcttagcttgataatctacaaaagcgcgatggccacatacaaaatagagacgaattccatttttatgtttcatagcttttaatattttaatcatgccaatttcacttgttgaacgtacatgaggggcacaacaagcgcaacaatctacaccttcgatttctaccaaacgaattgcttcattgatttcttttttgcttcgataatcataaagatcagcatcctctggatagaaacaatgaatgactttgttatttaaaatcacttcattggcctttgcttctaatatctgtaactgttgttcatttaaaaagccattataatccgttgtaatttcatggtcacttaaatgaaaaccactattatcaaaaccaaacatactttttacaagtcctgataaaacatgttcaccactatgattttgcatattattataacgataattgaaatcaatctttcctttaacacttcctgaaagaggagcattggtataatgatgaatttcttgattggtgatttgtacatcaatgacttcaacatcatttaaagtaccatgatcacaagtttgaccaccttcttcaggaaaaaataaagtttggtctaatacaatatcataatcattttctctttttgtacatgttatgacttgagcttcaaaaattgtctgataagcatctttgtcataaagtttaattgccatattatcacatccattctttcaaatcataccatatttaaatagatttgataatattatacataataccgatttcaatcaaagtaacaagtaaagaagtccctccataagacattaaaggtaaagttacacctgtaacaggaaataatccaacaacgacccctaagttaatgatagtttgtattccaatcatggaagtcataccgatcattaaaaaacttccaaagagatcgtctactttttttgcataattgaaacaagtaataaataagtaagcatataaaagaattaataaaatccctcctataaaaccaaattcttctaaataaatagcaaaaataaagtctgtttgtggttctggtaaataaaaatgtttttgaatgctttgatcaaaaccacttcctaaaattcctccaggaccaatagcatagagtgattgaatcatttgaaatcctgatcctaatggatcttgaaaaggatctaaaaaagcaaaaattcttttcattcgataaggggcagaaataatcattaaaataatcattaaaattccagatagtcctaaaaaaacaatatatcgaaacgggaaaggggtaataataatcattaaaagaatactgcaacacatgacaaagccacttccaaaatcaggttgtaacataataagaaaaaagccgattcccataacaataagtggttttaaacaataacgtagttttttcatttggtgataatgatggctgatatagtcactgacataaataataagcgctattttatagatttcagaaggctgtaaggcaaaaagtcccaaattaaaccaacttcttgaaccacctctgacaatacctactccaggaatgagtactagaactaaaagaattgtagcaagaataataattttaagactatgtttttgatagaggtgataatctattttagaaaagaaaaaaagtaaaagaagaccgactattacaaaaatagcttgtcttttaaaataatagaagctgtcattttctttatattgcgcccaaatatgtgaagaactatagaccattaataaaccaatagatagaataataaatacaataagaagtatttttctttttttcatagttaccaccgttttattatatgtaaactaattaaaattattttataaaaagtatatttttgatatataataaaggcgagaggaatgtgatgtttatgaaattattcttagtagaagatgctacgatttatatgattttattacaaaaattattagaaaatgactttcaaatcacattatcaaaaaatatagctgacgctaaaaaaataattgaagatgaagattatcaatttgatgttatgttaattgatttaattatgccagggacaatggatttgattagacaaataaaaaagaataaaagattgtcacaagttcctattgttgctttaacagcaagtgataatcctaaagatttaatacaagcttttgattatggtatctatgattgtattcaaaagcctatttatgaagaagtagttttacaaagagtaaaaaatgcagcaagtaattatttaagattgaaagaattaaagaaattacgagaatctttaatgaataatcaacaaattgatgatttaacaaagatatataaatttgatactgctaaatggcttattgatgaaaaattagatgaaaataaaacaggtcaaaaaattttgtttgtatttaagctaaagggtttagaagaagtgtacaaacaagaaggaagtcatcgaggagatgaattagtaaaagaaatgagtgatttcatttccatgaattttaaaaatatagatatattagggcgtgttgatcaagatgaatttgtatgttttgttaatcatatgatgtctaaggaacttgcttatgtaagaaaagaagaacttctaagaatgttttcacaaaagaaattatctgatatttctgaaaatatggatttacaaataggatattgtagaacttgtgaaactgtaaattatgaaaaaatgtatcatgcagctaaaaagatgttaacgaaataagaaaattatttcgtttttttattttttaaaagaaaaatgatttttgttgtctatataaatagtggagggagaaactatggaaacaaaaatcaaacctaaaagaattaccgattttaaaaatgatcttgtctttaaatttatgttgtagtgatctcaatgattctcgctgttattatttacttaaagtcattattgaaggaatcactggtattaaatgtcaggaactctttgtctcaaacagtgaagtcaatcctgaacatctaagtgataaagatatggttttagatgtctgagtgaaaactgatgaaggaaaattaatcgacattgaaatgcaaaacagtgcacttactaaagaagttcattatcgttttcaaatctatggagcaagaatgatagatcatcaagtcaatcgaggagatctcttatacagtgaaaatgtccatgaagtctataccattctctttgtcaatgatattgacagagacaatcttctcttgatcgatacctacatgccacgtaatcaactaaaccatgtcagaaagtataatctgcttacccatcataatgtctatcttccatttattgatgctgttgtaagagaaaaagggcttaagaatctaagcaagatagaattagctatttatactttatatcatgggataacagatgatataatggcattaaacagtgaggtggttatcatgatgaaagaaaagatggatcagttcaatgaagatgaagaacttgtattagcagcgagtaaaagacagcttgtcaagatacaacatcatcaagagaaagtaagaatacgacaagaagggaaagaagaaggcttaaaagaaggagaacttttgaaagctaaagaaaatacattgatgctttttaaaagtaaatatcctcaagaagatattttaatgttagaaaatttaacattgtcacaatataacgagatttttaaagcattaatagaaaacaaagatttacaaataattaaagaaatgattaaatgatacaaaaatggatatctcatgagatatccgctatttttatttatgagtaccaggtccggctttaacaacagtactaggtaaatcatattttttaaaattttcttggaacatttttgtaagctttttagctgttttatcatattcgcgtttgtttgaccaagtatttttagggttcaacatttctgctggaacacctggacaacttcttgggatttttagattaaagaatggttctttgacatattccacaaaatctaagtcaccatttaaagcagcattgatcattgcacgtgtatattttaatggaatacgatgtcctttaccataagagccaccagtccatccagtgttgatcaagaaaacattagctcctgatttttctacacgacgtccaaattggtgagcatataaagctgtatctaatgggaaaaatggttctccaaaacatgttgaaaatgttgcttctggttcagtaacaccattttcagttccagcaagtttgcttgtataacctgaaacaaagtgatagatagcagcgttacggtcaagtttagaaataggtggtaaaactccaaaagcatctgctgctaaaaagaaaatagtacgtggaataggtccaactcctgatgaaacagtatttggaatataatcaattggataaccaacacgtgtattttctgtaatagagccatcatcaaaattaataatacgtgtatcttcaaataatttaacattttctgttacagcaccaaaacggatggcattccaaatttcaggttcatgttcttttgaaaggttgatacatttagcgtagcatccaccttcaaagttgaagattgtatttctagaccaaccatgttcatcatcaccaattaatcgtctgtttggatcggctgaaagtgttgtttttccagttcctgataatccaaagaataaagctgtatcaccgtcgattcccatattggcagaacaatgcattgtaaaaatcttcttttgtggaagtaaatagttcataacacagaagacagattttttgatttctccagaataccctgtgcccgcaattaaaataatttgtttttcaaaattgatcataatagcggcttcactatttaatcctaattttttataatctactttacatccaggagcaactaaaatcaaaaagtcttctttaaaatcttttaattgttcctttttaggtcgaataagtaagtttctaataaataaattttgacttgctttttcattgataactctaaaaccatattgatatttacgattagctcctgcaaagccatcaaaaatatataaatctttatcatttaaatattgaatcatttgatcataaacttggtcaaaaacttctgctgaaacaggacgattaacatttccccaagcaattaaatcatgaacagcaggtgtatcaacaatatatttatcatctggagaacgaccagttctttctccagtttctatacataaagcaccagcacgtgaaagtcttccttctttatgaagtaaagatttttctacaagcgcaccaggcggattgtttctaaaaatgtttcctgtatgattaaaaccatatttttcgatattcaatgtatccataatatacctcctttggattccctacatataatgatacaaaaaaaatgttataaaatccatagaaagcgcttactttttttaataaatgacgctaatgtcaaaatgagtttgttgaaaatgtacagtttataaggcttttagagtattttttaataaaaaaacacattagaaacataactaatgtgtttttaggataataatcataaacaaataaaaaagatcatttaggggaatgatcttctttatttatatatagggaatcgagtaataaaaaattaatatattgggaaactattactgaaaatcgtaaaatatatgagagatataaatattatgggatatctcttttatttacatttcattttttattacacatttattatagcgaaatatgacgaattgagtagagacaaatatcctaaaaaggattgtaagtatttgtgcaatgtgcacaaatagtgtaaaatagatggtggtgatgatatgggatttacaatagatgatgctttaagagaatttaaaaagaattataaaatgacattacttgcaggtgaggatggatgttctaatgccatgacctgggtacaaatggtcgaagataaaacgattttacaacaactttggggtaaagaactagttgtaacaacaggtctaggatttcaaagccaaaagaaattaaaagaattcattgaacaacttgttaaatatcatagtgtgggacttgttatcaatacgggaaaatatatttttgatatcgatcaagaaattattgattattgtaatgaattaagttttcctttgttagtggttccttgggaagtgcatattgctgatatgatcaaagatttttcatatcattgtttacgtgcagaaagagatgataagtatattaatcaaactgttatggacacactgattaatccagcaattattgaagagtctagaaataaattagcaggtgattttgatgtggaaaatgattttcaagtaatggctatttctgtagaaaccgatgaagaattaggcatgatggaaagaagaagtattaagtttcagctagaattatgttttgaaaaagttgaaggaaattatagttttttctggtttgatggttattatattatgatttttaataacttagaagatagtgctcttgtagaagttattaatgaaatgtataaaagagctaaaaaacgtttgcattatacattacatttaggaattggctcaaagatggtagattttagaaatatgattttaagttataaaagggctattgcagcttgtaagatggctaaacaatttaattatccacaaatttattttgatgatatgggtgtttatcaattattatttattattgaagatcaaggtattttaagacaaatgtatcgtagtatgttaggtgttttgatagattatgatcaaaagcataatactcaattagaagagactctttatcaatatttaaaattcgatagtaatcaaaaagctatggctgaaagcttatatatgcatcgtaatactatcaattaccgacttaataagataaaagaactgacagaatgtcaattggattcatttgaagaaaaaatgccgtatatgttagctttttatattaaagaaattgtagaaaaaaagaagaaatagcggaaagctgttagcttctttttttatttgataaaaagtttagcaaataaaaatgaaagcgctaactttttagtgaatgttggtcatttatatgttataataaatgacataaaggggagataaatatatgtttgataattttttaattcacactttccatgatggaaattgtttacaagcttataaaatatttggtgcacattttgaaactcatgaaggtaaaaaaggtgtacgttttacaacatatgcgccgaatgctagaagtgcacaagttgtaggagaatttaaccaatggggtgaaacaccttgttatatggaaagatataataatggtggtatttatacaatatttgttgaaggtgtcaaagaatttgacatgtacaagtttagatttgaaactcctcaaggagatattattgataaagcagatccatatgcttattttagtgagttaagaccaggaactgcttcaaaagtttataacatggaaggttatcgttggcatgatagcaaatggataaaaaatagaactaaaaattatgattgcccacttaatatatatgaagcttctcttggttcatggaaaatgaagcgagaaagtgaaggtgaaggggacgatggtgaatattattcttatgaagaattaatagatgaaattattccctatgtaaaaaagatgggctatacacatttagaagttatgccacttactgaattcccatttgatggttcttggggatatcaagcaactggtttttatagtgcaacatcgagatatggtcaacctaaacaattaatgaaatttattgatgcctgccaccaagaaggcattggtgttattatggactttgtgccagcacatttcgttaaagattcacatggattacatatgtatgatggtggatttgtttatgattataatgattataatcgtcgttatagtccatgggatagtgtttattttgatttaggtaaaaatgaagtaagaagtttcttattatcttctgtagaattctttgcaacatattatcatattgatggttttagatttgatgctgtaagtaatcttatttattatgaaggtaataaaaacttaggtgaaaatattggtgctatggaatggatgaaacgtttaaatggacatatgtctgggtatcatccaactgtgatgatgattgcagaagattcaacagattatccaggtgttactaaaccagtgggtgaacatggtttaggatttgattataaatgggatttaggttggatgaatgatacattgaaatacttccaagaagatcctgtttatcgtcaatatgatagtcgctttattactttttcaatggcttatttctattctgaaagattcttacttgagttttcgcatgatgaagttgttcatggtaaagcgacgattattaataaaatgtggggattacatggagataaattggcacaagtaaaagcattgtatgtttatatgatgttacatcctggtaagaaattgaactttatgggaaatgaacttgctgaatataaagaatgggatgaatctaaatctttaggatgggatattttaaaatatcctgatcatgatgcattccatcatttcactcaaaaactcaatgaaatttatttgaaatatccggctttatatgaaatggattatgatttaaaaggttttgaatggcttgttgttgatgatcatgatcaatgtgttttcgcaattgaaagaaaagataaagcaggaaatgcgattatcgcagtgatgaattttgttggtaatacgcatgaaaaatacaaagtaccagttaatattgaaggaagttataaagaaattttaaatacggatcaagctgtatattctggaaagaatatcgttaatccaagagcaattcgctctaagaaaacaaaaccaaatgaaaaaacaaaattgttaaataaagatcattatattgaagtaaaattagcaccatttagtgcatgtatctttgaagtgaaacctaaaaaaggaacaacaaagaaaacaccaaagaaaacaaaaagagtaactaagaaaacaaaataagttgttcataaaatagagcatccgtagtttagatactctattttatttggaaaaagtaagattttatcaatgtaaaaatatttttatgagtgacaatctactaaaaataaagtatgatggtcacgtaaaagtaatattgaggagacgggaaaatgtttaaaaataaagaagaatttaaatttgaattttcaagaagaattattgaatcttatggacgtactgtagaagaagcccatattactgaaaaattcatggttcttgaaacaatggttagagattatgcatcagtaaactgggcagctagtaaagctgttgttcaaaataatgaacaaaaacaaatgcattatttctcaatggaatttttaatgggaagattattagttaataatatgatgaatctagggatctatgaaatcgctaaagaaggtttagaagattatggaatcaatattcatgatttagaagaattagaaagtgatgctggtttaggtaatgggggacttggacgtttagctgcatgctttatggattcacttgcttcattagattatccaggacatggaaatacaattcgttatgaatatggtttatttaaacaaaaaattgaaaatggttatcaagtagaattacctgatcaatggatgaaaactggatttatgtgggaagttcgtaaaccaaaacatagagtaccagttaagttctttggcaaagtgatttgggatgaaaatgaaggaaaatggaaacatgttgatgctgaaacaatttatgcagtaccttatgatgtccctgtaattggaaatgatacagtaaatacaaatactttgcgtttatggtcagctgaaccaagtgaagatttcccaagtaatcatgatttccaaagatatatcgaagatgtaagaagtatctgtcaaaacttatatccagatgattctacaccagcaggaaaaatgttacgtttaaaacaagaatatttcttctgttctgcaggtatccaagcaatcatcaaagcacacttaagaaattatccatcattagataatttccatgaaaaacatgttattcaattaaatgatacacatccagtattatgtattcctgaattcatgcgtttattaattgatgatcatggttatgaatggcaagatgcctgggatatttgtacacaaacatttgcttatacaaaccatacgatcttagctgaagctttagaaacttggccaattagtacaatgcaaacattattaccacgtgtatatcaaattattgaagaaattcatcgtcgttttgtaggttttgctaaagaagtaagtaatcatgatcaaaatttagttgatcgtacaatgattttaagagatggtactgtttatatggcaagacttgcaattgctggaagctttagtgtcaatggagtagcaagacttcatacagatatcttaaaagaaagagaattacatgatttcaatgtactttatccaaataaatttaataataaaacaaatggggttactcatcgtcgttggttagcttattgtaatccacaattaagtgaattaattaatgaaacaattggtaaaggatggatcaaaaaaccagctcaattagaaaacttaatggaacatgttgatgatccaattttacaaaatcgtttcttagcagttaaaaaagaaagaaaacaaatcttagctgattatattaaaaaacataatggtattgaagtagatgttgatagtatttttgatgttcaagttaagagattacatgcatataaaagacagttattaaatattttacatgttatttatttatatcaagaaatgaaatctaatcccgatttccgtatttatccacatactttcatctttggagcaaaagcagcaagtgcttattacttcgctaaaaaagttattaaattaattaatgcagttggagatgtagttaataatgatcctgaaacaaataaatacttaaaagttgttttcttagaaaactatggtgttactttggcagaaaaaatcatgcctgcagctgatgtttcagaacaaatctctacagctggtaaagaagcaagtggtactggtaatatgaaattcatgatgaatggagctattactataggtactttagatggagctaacgtagaaatttctgaattagtaggattagataattgtgaaatctttggtttaaaagatgaagaagttaaaaacttaaaagcaaacaatcaatatcgtgcatgggattattataataatgatttaaaaatccgtcgtgctatcgattcattaactaatggtactttctcaagtaatccagaagaatttaaaattattcatgatgaattaatgaataaaaatgatgaatacttcttattagctgatttcgaatcatatgctaatgcacaaagacatgttgtagaattatatcaagatcgtgctaaatgggctagaatttgcttagtaaatattgctaagagtggattcttctcatctgatcgtacaattgaacaatatgtagaagatatttggcatttagaaaaatgtaaattttaattataaaagctcaaggtcttaggactttgagcttttctttaatatatatttacttttgataaaacgataaggttccataaaatcacgcatttctttagcgtcaacttcttcatgattaacaaatctttgaaaaaaagatttgtttttttctgtcacagctttaatttcatcgattgcttcttctaaatgatgttctttaaagaagttgatgtaatactcttcggttttacttgccatatcttccttatttaataagacccaattttcttgatgaacaacatcaatcaaattgatcaatgttctagcagcttgttcttgatcaatcattttttttcacctcgttttttattatagcataaaataataagttgtgttataatgctaaaaaatgatgaaaaagaggtacttatgatgaataaaccagtaattgcgattgttcctttatatgatcaagaaagagatagtttatggatgcatccagggtatatggatggggttattgaagcaggtggtattcctgttatgctttctttagttaatgatgatgtttctttaaaagaaacggctcattattttgatggatttatttttgcgggaggggatgatttaaatcctgaactttatcatcaagcaaaagcagaatattgcggaaaattaaatcaaaaaagagatgaaatggaaccaaagctattaaaatatgttttagaggccgataagcctgttttaggaatttgtagaggtattcagttattaaatgcatgtttaggtggaacactctatcaagatttagatcaacaatttcatcctacatgtattcatcgacaacctgctccttatgatcatccaagtcaccaagtaaaaattgttgaaaatacacctttaaaagacatcttaaatcaagaaactttaatggtgaatagttgtcatcatcaagctatttgtcaacttgctccagcattaaagccaatggcttattctgatgatggattagtagaagctgtttatctaccagataaaaagtatgtgataggatatcaatggcatccagaaatgatttataaaaaaagtgatgatcatttaaaactatttaaagattttgtggataattgcaaaaaataattataaaaaattataaaaagctataaaaacagtaaatgtgtattgactttatgctgatatattagtataatgaacaagctttaagttaataaaaagcaagggatggttccttggccaagttggtaaggcaacagactgcaactctgtcatcatcggttccatgaatgatgacacacttaactttggtggtatcattactaacatatgtacatgatcactcatcaaatgcccttctattatctccacccctttatatcggcagagtgttctcaatatttctcctatatctttccttcgttgattatatatcacttttcgtctatactttggtgtgaagacgatgtgctaaagaatttgcttttttagccactatttattattgcaccacccacatagcaggtggttttctatttcgcacatttcatgtgctcaactgactgaagtcatcaattctcttttcattcaaattgtataaaaaaagaacaatgtaatgataagacattgttctttatattttactattatgcattattttttcttttatttttgctggtttttcatcttcacccacaactcttgtcttagcaagataatcatggatacttctttgagaagctgatcctagaacaaaaactcctgaaatcattgtaataaccataccaatcatttttaaataatagtcaaaatagaaacctgttgctagtgtaagcatttgtcttaaataattagtaacaacaatagccgaaccttctaataagaataatccaaccccttgtctaataatcaaagtttttaaactcacatcactataatcatcattatttacaatctttatttttaaccaatgttttgcgagtgtttgtcctggatatttcttataaggaatataaatataataaacaaaagccacaacaatacataatatacctgcaagataggaccaatacgttggaaaacctaagctaggaaaaacataaagatcactaaacatatctgatctaccagtaactcccccatagaataaaacagcaggaaaaccactaataataccgccaactgcccaatcaatagcataagctataacacgtttacttactggaacttttacaggatttctatctagccattttgtatgtttagcccacagtaattgaattttaattaataaataatgcataataaatacctcctattttgaatataatgcatccattgctattttaaatcttcgcaatccttcttttaatttagattgtggacaccctatattcattcttaaatattttgggccaccataaatttcacctttcataatcccaattccaccaacattcactaaagcatcttgtatctcttcagcagtatatggaacatctcttgcatcaatccaagctaaataagttccatctggtgttttaaatttaaaatcaggcaactcttcttttataaattcttctacaattttcatattttctttaatataatcattaagttgatcaatataatcatcgcattgtgtataacctatcattgtcgcatacataccaaaaatacttacagaatttaagaaatcttttcttcttgtatgcatcaagaatttttctctaacttcttcatttggtatcattaaatatgaaccaattaatcctggtgtattaaatgttttactagatgaagctgctgtataaagttcatcatattcatgaatataagataataaagggatatgttttctatctcttaattgaatatccatatgaatttcatcagaaataatttttacttgatattttttacatatctttattatttgatccatttcttcttttgtccaaattcttcctgttggattatgtggagaacaaagtaataataattgacattcttgtacttgtttttcaaaaagatcgaaatctatttcaaatgtcccatcttttgatattaaacgatgagccactaattgtctatcattatcttggataactgtataaaatgaatcatacataggttcaaatgttaatactttatcatgaggttgacttaataaacgaatcaataaagaaactgaatacatgactgttggactatataaaatccaatcttcttcaatatgtgtatgatgtcttctttcaaaatatcctgtaatagatgatttaaaatcatgatgattccatcttgtatatccataaatttgatgatgtgccacttcaaatattttttcagtaataggtttaggaataataaaatctgtatcagatattgaaaatggtattaaatcctttttattaaaacgatcttgtatataatcccattgtgtacaataagtacctaaacgattatgaacctcattaaaatcatacttcatttatttatcctccaaaataatataatcctttgttgttttatttaatggtacacctacaccatcaataataacaacatcatcttcaatacgaacaccaccaacaccaggaacataaacacctggttcacaagacatcatcatatgttcttgtaaaactgtttcactctttgaatttaaagttggtccttcaccatcttcaccaattcctaatccatgtcctaaaccatgattaaaatattcaccataacctgcagcctcaatcacatctctagctgctttatcaacatcttttcccttagctcctgctttaatagcaccaagaccagcgagttgtgcctttaaaacaacatcatagatttctttgatttttggatcaggttctccaataaaacacatacgtgtcatatctgattgataattttgatattgaataccaaaatcaatcataataggttcatgagcttttacttttcttgaagttggacgaccatgtggtaaggctgttctttcacctgttgctactattgtatcaaaagacatttgttgtgcaccagatgcaattgaataatattgtactaaagcgctaatttcatattcactcatccctacatgaatgtgctcaattactttttgatagatttcatcagtaattgcaattgattttttcatagcttcaacttcttcatcttctttaacaatacgaagatgagcaatttcttgatccaataaaagaacttctatccctaatttttctatttcttgatattccttaactaatacttgatacgcttctacccctagcgttttacaattttctttttttaatatttcttctactgtccctaaataattacgtcccgttaaatgtggattatgtaatataatttctaaatcatgttctttttctttggcttctgtaatataacgcccatctacaattaaatagccatgttcttttgtaatcaatacttgacaaccactaccagtcatagtattcatccatttttttactgttttacttttaattaataaagcatctatatctttttcatctaaaaattcttgtattttatttattctttttgccatttttaatcctcctacaaataaaggcaagtcgaaacttgcctattaattagaagtctaagtctaaatcatctaagatagctgcatcttctgcactgatagcattagtttcttcttctttattaccataagtcttttcatatgatttaacaaatggataccatattaaaatagatagtattaattgtactgcattaacaactatagacataggatccatattcgttaagaatccttctaaaaatactcctacatatggtggtgtaaaggttgaacatttcataatacctaaatacatcgcccatccacctaatgaaccaataataccaccacaaataacaaatggaataaagaacattggatttaatacgattggcgcaccaaatagaattggttcattaattccaaataatgctggaataaatgataatctaccaacttgttttaaagctttattcttactcattaagcaccagaatacacaaccaatagtaacaccactacctgtaaagttaccaaatgctgattcaggtccaggagcatagaagtgagttgctacatgaccagcttgaacagcagcaatattttctgctaagaattgagtcgaaattggacttgtaattgggcttaatactgatggatgaataccaaagaagaatattaaagcttgtaacatttttaagaaagtataagcaattggattatccatagaccctactaatggtgcaaagattgctgtaaagattaatggtggcattgtatttaatacattgacacaaacaatacgtacaattaagaagaacccaataatgattactgaaataggaatcatttcaaaagaacgagatacgaaatcaggtactgtatctggcatcttgattgtaaagtttttctttttacaccaacggaataattcaacagcgataaatcctgcaaacattgcacagaataaacctttaggtcctaaataagttttagaaattcccccatcttctgtgaattctacaactaacattaagaatgatactaatcccattgtcacacatcctggaatatctaacttataagagttagctaattgatatgcaataattacagtaacataaactgacattaaagccatacctacattataaggaatatagataatatccaaatttgttaatatccattgagaaattacatgtttttctccaatcatatttggaattgcttctggaatcaaacaaaaactaccgataattaacaatggcgtcattgcaaccattgcttttttaacagcgctcaaatgaacttctttatccattttatcagcaagcggtgctaaatactttttcataaagttctcaaattttgagtacatcgtttttttcctccccataaaattatttttttaaatctgcttttctacgcgcaattaacgcttgtttcatgacagttgccccatccatttttccatatgtttcttgatcaacaataacataaggaatcttacgaggttcgatgataggttttactgcatctaatttatgtgcaacttgtggtcctaaaactaaaacatcacaattgtctgcttcagattgtagaatatcaattggaatagcgataaaatcaaaatcagcatcatttaattttgcactgttatgtactgtatctttcatactattcataagcattgttgtagaaagtccacctgcacagcataatacaattctcattatttaccctcctttgcttcaaatacatttattagttcttcaattagatctcttgctaattgagaagtcatataatggtcttgtgcatgaaccattaataacccaacttctggcttatttccagagcctgacatttcggcttgaataagctttgtttgaacagtgtgagcttgtaaatcagcttctttagcttgttctaatatctttcttgcttcatcatattcacctgtttttactttcttcaatgcttcaaaagctaaagatttgctttgtccagctgaagaaattaatcctacaataatttgttccgtttctgtcatttgtttatcctccaataaaattaataaaattttgataatcttgatatgtcaaatgatctattaagcagttaactaactgtgtcaaactttctaaatcatcactatgaacaaatgaataagatccatgacaatatctaagtggtattcctaaaacaagtgccaaacgtccacctttttctaagtgtgcatttccagcatctgttcctcctccaccgaacatatcgctttgataaggtattccatgtttactggctaattctttaacatatttaatcaattttttatttggtgaaagagttttgtcataatgaacaatcattggtcctttaccaattaaacgatgattcgtatagtttttaacaagttctggattatttgcaacatcaagtgcaaaaacaatatcaggatcaataagatgagtcgctgttttaccacctcttacaccaacttcttcactacttgttcctacaaaataaatatcattttcaacatctccatgaattcttttcatcgcttctatcatgacatagcatcctgttcgatcgtccattgccttgccagcaatcactttatcttgaatctgtcttgcttcactagcaaaacaaaccatgtcaccaacatcaattcctaaagcttttacttcatctgcactatcaactccaatatcaacgtacatttctttaacgttaccgttgctatctttagtcacatttaataagccttccacttttttaccatcttgcgtcgtaattctaaccatttgcatttctttgcttttatttaaaactgaacctaaagccactaaatatacaaaaccaatatcagaaatatgtcttaccataaaacctacttcatctatatgagcacaaaacataatttttaaaggattgggtgaagttcctttcttatgaaagataatacttcctaaacaatcactaaaaacttcatcactatgttttgctaattctcgatagagaatcgatcttacttcatcttccactgatgctacactatcagcattactcaattcttttaacaattcactattcattatttccacctcctatttctttcattaaactcatcatttcttcaaaagaatcaaccttcgttaacatttcaacataattactcttttgcattaaacgatataactttttagttattactttatatatttcaacttgatctttctttaaacaaatcataaaaactatttttatttctttgccattttgtacaaatggtttctttaaaatagctacagaaatcatatttttaagtgcgtctgtttcaagtggatggggtatacaaactccatttgtataaatagtacttacatacgattcacgttcaaaaatcaaatcagtatagccttttttaccataacctttttcctctaattcttgtcccatcatccgaataatattttcataactatctgcttctataaatttaaaaaaatctttagaaaaaaatgaataatacataggattatcttgaatcaaagtataaggatcatattcttcacattgtaaaatttgtttaatcttaactaaatctctatcatcaagtagttctttaatataaataattggtgtcttgatttcttgagataaaggcatgattgtaaaaattaaatcaggttgaaatgttttcaattcatcttgttgtaaaaatgaaaatgtttgtacctctgcttgaggaaataatgattcaatttgtatcttgatcatataagcacttccaccacctgatgaacaaacaattccaatatgattataagataacaatttaccttgtttttccttttccatatgcgatgcaaaatgcatcgctacaaaaccaatttcatcaaatgtcacttcaacgttgtatttttcatgtaacatgctacaaaattgaagagcgatattaaacatcattgggtatgtaatatttagctcattggctaatggattttgatatgaaattttattatgtaatctatctattaataatgaaacatgtgttaacaacattttcttaaagtcttcatcttcaagaaatttcgtatcatatttttcatctatttgttttataaattcttcaatgtcttcttttaaataatttgtaaaagaagatattgaacctatttctctttttatatttttttgtaaaacttttaaaatctcttctatgctttttttacttaatcctatagcatatttcttttctaatattccaactaagaattcaacaattcgatgaatttcattatttttatcaaaaataaattcctctttttgttcatcttgtctatgtgcaatataaataacaatttttaaatactcaatcacatttaaaagttcattatagttgattttcaatccttctttattcaactgtctaattaacttttgttcaatgtcattaaattcttcaataacatcatttactgccgtttgaataaaaacattttgatttaaatattcttcaactaaatactttttaaaagaagctaattcataacgtaacaaaataccataatgtgtttttctctctaattcaaaatgataactctttgctagattttcaacatctttcatatcatgctttacaactgtcttagatacttgaaaagtatcagcaatgttatccattgaaatatatcctgtttgaatagcaagataagctaaaatttgtgctggtctttctttaacctgaaaataaataccttcatttaagctttccataaaatctttaaacaattcttcatttgttatttctaagagatatccagaacctcttttgttatgaaatgtaaaaccttttcgaggagaaatacgcattaagtatgataagtcattttgaatcgttctttttgaaacatcatacttttgaacaaagtaatctagtgagagatatatatttgaatttataaaatctttcataattagatacattctcattggtatttccaccttcctctgtctttattatatcaaattaaaattttgtcaaaaggaaaccttctacatttaaaaatgcaataattttcctaatctcatcaaaaaaagatattgaatataattttaacatctctaccatttaaacggttaaatattacaaaatataaaagccataaaaaaagaagtctaacagcgttagacttctagaaattatcttttaatcaaaataagtaatttttaaatctttaaaaaaagcttctgttccaatatctacaaagaaaccaatatttcctctcatagatttaccatgaatcatttgatccactaccaataatggttgaggatcatcatttaaataaaatgtagctttttcatcttcaatcacagcttttaaactgatccattcatttaaatcaatatctacttgattttcatattttgtaataccacgttctctaaaataagcaaatgtataggttggataagaaaaatattgacaaccatgttgtttccttaccgggtcatcacattgtctaccatttgttggtcttacataaaatgattcaaactttgtatcatcttcattaatacgataagcaataccaataaaccctctcgcaaaatcaggagcatcttttaataaacgacttaacatctttacttcaataattccattatgaaatgatgaatcaactaatttagcgtatgtattttcatcatattcattaatttttccacttttaacaactcttaaaaccttttcattatcaatcacttcatttgaaatatgtgtataattttctttccaattttctttattaatcatttcttattcttcctttcactaacatcataaagtagcttttttatttggtaaagtaggcacttttttgtaaccttgatttagcacttaattgattcaagtgctaaaaagttcacattaagttaacatataagactataatacaaattagcacaaggatatggtgagtgctaaaggagtgaatagtatgattaaaccattgcataagtttgtattaattaaaaaagaagaaaaggaaaataagacagcaagtggaattgttttaacgactgaaaagaaagaagttccatctattgccagtgtcattgccgttgatgatgaatgtacttcatcattaaaagaaaatgatcgtgtaatttataaagaatattcaggtacaaaagtaactgtagctgatcaagattatattgttattgatgaaaaagatattattgctaagtttgaataagggggcagatatttatgagtaaagaagtaagattttcaaatgatgcacgtcaatcaatgttaaaaggtgtgaatgttttagcggatgcagttagtgtaacattaggtcctaaaggacgtaatgtggtcttagataaaggttatggttctccattaattacaaatgatggtgtaagtatcgctaaggaaatagaacttgaagataaatttgaaaatatgggtgctaaacttgtatatgaagtagctaataaaactaatgatgtagcaggtgatggtacaaccacagcaactattcttgctcgaaatataatcgtgaatggattgaaagctgtagataaaggagctaatcctgttttaatgcgtgaaggtattgaaaaagcaggcaaagaagttgctgatgttgttttgaaaaattcacataaagtagaaacaagtcaagatattgcttcagtagcgactatttcagctggtaatgaagaaattggtcaattgattgcttcagcaatggataaagttggtaaaattggaattatcaatgttgatgaatctaatagttttgacaacgtcttagaaatcaatgaaggtatgcaatatgataaaggatatgtttctccttatatggtcacagatcatgataaaatgactgttgaaatagaaaatccttatatctttattacaaatcataaaatcaataatttacaagaaattcttccaattcttgaacaaatcgttcaaagtaataaaccattattattaattgctgatgactttgaaaacgaagttatttcaacacttgttttaaataaactaagaggaacattcaatgttgtcgcaacaaaagctcctggatttggagataaccaaaaagaattattacaagatattgctgctttaactgggagtacctttattaataaagatatttctatggaattaaaagatgttactcttgatcaattaggaacaattaaaaaagtaatcgttacaaaagatcatacaacaatgattgctggtaataatccatcagatagtttaaaacaacgcattgaaagtattgaaaatcaattagcgaaaacaacttcttcttatgatcaaaaacaattaaaagaacgtttgggtaaattatcaaatggtgtggcaacaattaaagttggcgcaacaactgaaagtgaattaaaagaaaagaaattacgtattgaagatgctttaaatgccactaaagccgctgttgaagaaggtattgttattggtggtggtgctgctttagtagaagcatataaagaagttaaacctcaattaaaatctgataatgtagatgttcaaaaaggtattcatattgtcatggaagccttatttgctccaattcaacaaattgctgaaaatgctggatataatgcagaagacattgttgaaagccaaaaaactgcgcaaaagaattatggttttgatgctaaaaatggacaatgggtcgatatgtttgaaaaaggaatcattgatccaactaaagtcactcgtagcgcattattaaatgcttgcagtattgcttcattattcattacaaccgaagcaggtattgccgatgcaaaagatacttctaaaaacgaagttccaactcctgcaatgtattaatagataagaaaagtgattcttgttttaaatgagaatcacttttttcttagtatattatgatataactttatccattactctttcttttctttaaatcttcctgatatgacaaaatgtatttgttctgcaatcttaaattctattttaaaatgatcatcttcttgcccataatataaatccacaatactctctggagcaatttctttttgatagtgcattgtcatttctccaataaaatatttttctaatacgttttgaggaagaagatccatgacccattcaagatatcttgcattattcatatgcttatttaaatcaatatcactatacatgacttctcttgtttgaactttttgagtctctatatctaaaagcggctcgtatttttctacaaaactcgaatattcttcacattcaggaattgtaattcctactttttgtggtctgacaattcttcttttttcaatatctattaatgtccaaatagaataaatgcctcctacaacttcatcattaatttttaaatcataggttctaaaatattgaatttttctttcccctttagcacgggtagaaactatcagttcctctcctactaatagtggtctttttaatttaactgtttgtttaactaatacccaaccatattttccattaaaactttccttccacaaacctatttccatcgcatttttagttgcaagattagaaagctttgataataaatccgcatatttatattcaccataataatcggcgttttggtattctatttcatatcgttcaaatgtttcactgtttttcatttttttctccaaaatgtttattttttattaaattaataataatatatttataatcaaaaggaaaggctggaaaatatatgaaaaaaataaataagaaaaaaatattctttgtttcaatcactttcttaataacactatgtttacttttttattttatattttcttattattctactcctatccaacctagaacaatacataaaaaaaataaaaaaaacacatcctaccctactgtttcctttgttgcagtaggagacaatattatccatgaaaatgtttatcaatatgccttaaaacaaggaaataatacaacctataattttaaaccttgttatcaaaatataaaaaaatatatttctgatcatgatttagcttatattaatcaagaaactttgattgctggtgattcttatggaattaaaggttatcctaattttaattctcctgaatctttaattgatgatctacaagatacaggatttaatatggcttctagtgctacaaatcattccatggatctaggaaaaaatgctttgatatcatctgcacatatttggaaacaacattccgatattctcttttctggactatatgaaaatcaagaagaccggcaaacaataagagtcattgaaaaaaacggaattcgttttagtcttttagcttatacttttggtgttaatgaaacaaccaactataaatctattcaaaaacaattaaaaacgtatccttatatattaggacaattagataaggatcaaattaaagaagatgtaaacaacgctaaagctcaaagtgatgtagttattgtagctgttcattggggtaaagaaggacatagtgaattatctgatttacaacaagaatatgctcattattttgctgatttaggtgttgatgttgtaattggaaatcatcctcatttaattcaacctattgaaaaaatcaatcatacacttgttatttattctttaggtaattttttaagtacgatgaaagatgtttataatcagttagaaggaatggtatgttttgattttgttaaaaaagaagatgaaatcagtattgaaaatattcaatatgttcctcttgtcaatcattataatgataatgttgtaactatttattcacttaaagaatatacttctactcttgctagtcaacatagtattttaaaagatcaagctaatatcattaaagaattcaaaaattatgttaaacaaatgattagtaatgatgatattgatatagaaatgtgaggtttatatgaagaaaagaataagtctattaatattaataatctgtatggttggtagtatcgtttttttctttcctaaaaagaatactcaggaagtaaaaacggtaaaaaagaaacaaacacctgaaataagtttttatcatcaagaatataaagaaagatatgatacctaccaaaaagcacaccaagatttaagtaaaaaagaagttattacacttgtaaatatgaatcgtgattttgatttttatggaaaaatcatcaaacaagaacatcctaatgatttaaatacaattgttaataaatattatcaattagatgaaacctatgaaccgagtgatcttgttgaaataaatacaaacgcaggtacttatggaagttcttatagtaaacatactgctagaaaagtgatttatgatgattttcaagctttaaaacaagcttgtataaataaaggttttgaactgtatgtgacttcaggctatcgttcaacagcctggcaaaaagaaatttataatcatatggtagaaacttatagtgtagaaagagcagatgaaacttgttcacgtcctggtcatagtgaacatacaacggggttaggcttagatattgctttagatcaatataaatatgaagaagttgaaaatcaccctcaatattcttggtttttaagtcagttaagcaactatggttttattttacgttatcctaaagataaagaaaatttaacaggatacagttatgaagcttggcacatccgttacgttggtaaagaacttgctcaaaagattgaaaaaagcggattaacctttgatgaatattatgcaagacatttttaaaagaagatagctttcatactatcttctatgtttccaatattcaaaaacaggtatttctggatgttcatcatcccaaggcatttcatgtctttcaaaataaccaatgacgtgtttattagaatctctaacaggtacaaagaattctctttcacctgttttcatattatacgtttcaaacatttcatcttcaccattatctgctctttttaaaaattcttcgattttctttttagaattttcattatgacaattaaataagctttggttaatttgtacacgatcaccatagcgtttctttgcagttttattcatataacgtacaatatgttgacgatcaacaaaaacaatttcataactataagcatctaaaatgctttctaatatttcttttgttatttccatggtatttcctctttcttaatttacccacattataacataaagtctgattgtctttattttttaactatactatttttgttttttcttgtataataatatggtaattatttaaaggagcgtcttttatgggagatttaaaatatttattacctattttagtagctgttattttagtgtggattacttatcttgtcattaatttcgtagctacaattattaaaacaaagaagaaagatgataccatggtttgtggtttaaacatgcaaggaaaaatattctatgcaatcattattgttatttatttagtaatgcttgtttattgtatttattacatgattacgcatttattaagtggagatgttgatagtgtttatttaccattaaatgctttaacaatttattcttttgttttctatttaatgattcaatggattattttctttggacaaaaacaagttttaattggtcgtgttttatttgattatagaaaaattaaaagagtgacttatccaaagaaaacaaaattacgttttacttatggacaaaagacattagaaacatatattcgcttcatcgatgattctattcttaaaaaatcattacaaagatcaagataaaaagcaatttcggttgaaattgcttttttattggactggaatccaaattgtatgataattaaaatattcgtcttcaggtttccacattgaaaccacttgagaaatcacatctcctgcaagttggagattatttttttccatataatcaaaggcgggctgtaaaacctcatatgtcagtatttgactcgaacgagaaggaacgcacatataaagacataactgttcaggatagtaatgaacatattcactttccttaatatcaagtactcccgcaaattcttcctctacccctattccatagtagaattccttattttcattttcaatatgttctttaggaaaaagcgccgtagaaaaaacaaatggtattttttgacaaaattctttaagttcttcacgttcttctttctttaaatctatcgtataacatttttgtgtatcaatacgatagattcctggtcttttttgtaaagtaaagtttaagttttcacttcgactaatcaactttctattcgtacgtaatcttttcaataaattcatttgataaataatattcttttgaatgatttgttcttgttcttctaataaatcatcaatttcttctaaagacttactttggagtattcccgctgtttcttcaattgataatccaaagccaagataacagcgtgcacgaatcagcatatgaagatcccaagttgtataatagcgatatcctgtttcttgatcatggatgggcgcaatgattccttttctttcataataacgaattgtttcagctgtaattcctagtattttagcaagttctcctattgtataagtattgtacataatcccccaaccttcaaattgttttaaagttttcaccaaattataacatattttcctcttttttgaccttatttgacacttttttacccccttgactctcaaatcgtttgagagtttaaaatgactttgttaaaaaaataacatgtgatgttaaataaataacaaagggagagaaaaaattatggaagaaaaaaaagttgttcttattacaggtggagcaatgggacaaggtcgtgctcatgcctacaaatatgctgaaaacggatttaatgttgttttagccgatatgttagatccatctcacgaagcatttaaagaaacaattgctagttgtgaagcaaaaggagcaaaagttttagctaaaaaagcaaacattacttctactgaagatatggaagcattatttgcttcagcatgggaaacatttggtcgtttagatgttgtgattgctaatgctggtgttattaacttcggttatacttgggaattaactgatgaacaagttgaaaaagtaatggatattaacttaattggtacttggcgtactgataaatatgctgctcaatatatgttaaaacaaggatttggtcgtattattaatatttcatcaacttctggtttatatggtactcctcaattagctacttattgtatgagtaaatggggtattttaggattaactaaaactcttgctaaagaagtgggttctaaaggaattattgttaatgctttatgtcctactaaagttaaaactccaatgtgtgaaacaatggattatgttaaattcattaatgatttaactggtaaagatttcaaatctgttgaagaaatgtatgcaggagttccattccttgaagtagaagatatcgctagtatggtttactggttaggaactagtagagaagctggtaaatttaatggacaaggtgtaccacttgatttaggtactttacaataataaagggagaaaagagaatatgaaaattacaaaagcaacacgttggcgtgtttttgcaggagtttggattcaaagtttattcacttctgccactgccttctttagtttattctgtttgccattttgtaatcaatttggatggagtaattcagatttttcaatggcatacacaatttatatgtttatctactgtgcagtaggtttccttggtggtattttagctgaaaaattacaaccaagagtcgcaatttatattggtttagttttatttgctggaggatggatcttaactggttttgcttcatctattccattcttatatattgcttatggtgtcattgctggtgctggtgctggaacaatttatcctgcatgtttaccaacagcattaaaatggttcccagataaaagtggttctatctctggtttagttcaagctggagctgcttgtggacctttcattatgtcacctatcgctcaaatgttaattgataactttggagcaccaatggcttgtaaaattttaggtgttgtattcttaatcggtgttggagctgttgcttggatgattgttccttgtcctgatggatggactcctgaaggttgggtaccaagtgcacaacaaagcaaagaattacatacaaaagattataatattcctcaaatggttaaaactccaatcttctgggtattattagtaatgtttattttcgctaatgctgctggaacaatgatggtttctgcaacatcaccaattgctcaaactcaaattggtttatcagcgatggatgcagctttatgtgtaagtttaatgactttatttaatatgtttggtcgtttatcatttggtgttatttatgataagttaaaaggatggaattctttaattcttgtcttgattttaaatggtatttcaatgcttatgttaacagtagctcattcatttgcatactttgtcgcttgtattgctttagttggtttctcatttggtggattacttgttgttttcgcaccaatggttaaaacaatctttggttctaaatattataatagaaactatggtttgatctttattggttatggtattggggctttcgttggtcctaagatttccgcaagtttctttgatgctacaggatcttatgtgatgggattcattggttcagctattcttgctgcagttgctgttttattagtcgttgtggctaaaaaacttgctaacaaaatgttaaatgcttaattttaaggggtgaaaaatttcacccctttattttatactttcctttaccttctttaatcatttttccttcatcacaaagtttctttaagattctttgtaattgtcttcgactacagtgaagataatttgtggcttcttcaatgctttttaatgaaccataacaataatatttcaaataatataaaaaacgttcttcaacactttgataaacaaattgattggttgatgattgttttaatttagaagcgattgaatttaaaagtgtatgtagaaattttatatcttgattaagcttttctttattatcttttaaagatagcgccaacgttttgacctttgtttttgcttccgcaaaaaacatcggatttaaatcatcaacaaattccatatcacctaaaatacataattcttcgctttgagaaactacagtttgtcttccctcttgatcaataaaagaaatcaataacgttccttttaatacaaattgaatatattgtgttttttctaaaggattgattattgtttcatcttcttcatattcaatcactataaattcatattccttagaaaaataattgtctattttatattcttcttttactttatttattaaatttttatcatagatctttttcatacctctattgtgacatatgtcacaataaatgacaaatcattttgttatactttcctagaaagagagatatttatatgaataataatgatttatttgaaaaagcgcctatatctaaagcatactttaaacttgctttacccgttgtattaagcatggttatttctttagtctataatatggttgatacattttttgtagcacagacacaaaatacaaatcttgttgctggtgtttctttatgtgcgcctatttttactttaatgatagctttaggagatatttttggtattggaggtagctctgttatttctcgtttatttgggcaaaaaaaagatgaagaaggaaagaacgtcagtggtttttgtttctatggagctattgtttgtggtatcttagtttctcttattatgatgattgctagaaaaccaattttaacaattcttggaacaaatcaagcaacacttccttatgccaaccaatactatacttatatggctttaggagcaactttaattatcgtttccttgactcctagtaatctcatgagaacagaaggattagctacagaatccatgattggaacaattactggttcaattatcaatatggttttagattctatttttattctctatttaaacatggaagctggtggtgcagctatcgcaaccattattggttattttgcatctgaccttgtttttatttatcttactttaaagaaaagtaagaaattatcaatttctttaaaacatacacatattactaaaaatgaagtcatttctatttttacaattggtattcccgcctctattacaaatttaatgtctagctttgcgatggcgatgacaaacaattatttagttgcttatggaaatgacaaagtagcagctataggaattgttttaaaaatcaatatgattgttttacttgtcatgattggttttgcttttggtgcacaacctttacttggatataattatggtgcacataatactaaacgtttaaaagaaattattaagtttgatttatttgtagaaattacttttgcagttattacatctattatcttagctttatttacaccatcatttattaaaatatttatgaatgatccttctattattcaagctggaacattgatgttaagatttttgcttttatcttctccttgtgtaggaattattcttgtctttacaactttatttcaatcagaaggaaaagcacttcctgcattattactttcaataggtagacaaggtattgtttttgcaatttgtcttcttcttttatcaaatatttttggatattatggtattattagtaatcaaatgattgcggatattatcactgcaatcattgcacttattttatataaaatatataaataacaaaaagatgtcttgtactatataagacatctctttattttaaaatacttataatcttttcaatttgattttttgtaagtacttgattccttcttagatgtaaaatatcatctatttcatttttatcattaacagtatattcgctttctactggactattcatatttacaaataaaacataaccttctatccataaatcaacaccataatacttcaataacaaaccattttcatttaaataatgatttaatatcttctttgcttgtaattctccttctttccctgcaattcttttttgatcttcatcatcttcatcacttgataaacttaaaagtaaaaatatgaataatataattacaaaaaagataatcactattatctgcattatgtatcacctcttatccattataacaaaaagagaagaaccaaatcttctctcttttactttctaacgaacacattttttcattacaatcatataaattcctaataagcttatacctagtaaaaccattggcacaatactatttgtattatctcctgttgttacagcttttttactttctacttttatttcttctttctttgtttcagttttcacattttctaacttagcaatcttttctgtttctaacacttctttacatactgtacattctttatgttttgatccttctttagctactgttggttgttgatcaatgatccaatcacttgatatatgttctcctttagaatccttatcttcataatatttattgattgtttttgatgtttttccacatcttgaacatacataccaatatgtatcgtgttccttacaattagttgctttttctcttaaaaattgtggattcttaacttctatataagcatgtcctaaatgagtacctgttgctgcaaatgcttctgtaccttttgctccacaaatacaactcttataatatctagcaggtgtcatacaagtagctggagtcgctaaatattcactactttcaacttcttgattatacacatgatttcctttatctgaaacttcattacatcctggaactgtgcatgaatgccaatgattattagaatctttatgccaatctttagagaatacatgatttcctacttctgcagattcataatacttatcttgtgcattttcatcatctttagcacttacatcacatcttgaacatgcataccaatatatatcatgttcttgacagttacttccttgagattttaagtattttgaatcttttatttgttttgtatattcatgtcctaattttgtatctttatcttcaaatgtttctgtagtacttacttgaccacaagcacagcttttataatagatagcatttgttgtacatgttgctttgtcttttaaagtacttactccattgacttcttttaatttttgatcaaaagtatgttcttcccaaactgctttaatttccttattttgatcatctttagtaaatactcttttatctcctactttataaacagtattgtctacttgccagcctttaaaatgttttccatttggagcaacatattcacattttgggaaagtaaattccttatctaattcaacagttggattagccattgttcctgttccaccattagaaccatatttgatttttaattggaatactaatgcatcaattgcatcattgatggcttttgccatagcatctacttcatcttgttctgttatatttttactacgtacaactgttttaatagcatcttctacctttgaaaaatctttatagttatctttattaagtttatttgctttttcaatagctttatctacttctgtataatctgcagctttatattctaattgatcaattgcttcattaatagcatctgcatagccattaacaacctcttgttcagtaatatctttatcacgattgactgcgttaatagcatcctctacctttgaaaaatctttataattatctttattaagtgaatttgctcttttaatagctgcatctacatctgtataatctgcaccagcatatgtcatacttaataatttagctataacactatcaaatattgctgtagcctcttttgagcttttagctcccatataataagcactattttctgctctagttcctaagtttttataactttgggcatctgagtaattactagaaactccatgcatataagcattaaacttttccgcatctgaccaactaccacttcctacatgtccagtaatagatggatcagttaaagaaaacattccaaatgtataaacttctgcatctttttttatttcttttgatgtattaattgctccatttgcgacatcatcatcaaaattattcaaagtcgttggctgaccatccgttacaaaaaaaacaattcttttggcatcttttctactttcatcatttttactttgattaatttgttttaatgctaattccattgcaaaatctgaacgtgttgcccctgcaggactaatgctatttacaacatcttctaactttgctttattgtcatttgtggcagtaaagaaatcactcatgatttgcgtataattatacgtattacgattttcttgataagtatcatttcctattttatctgcattatcaggtattttccctgaaaatttaataatcgaaattctactttgatatttttcatcactctgttttgaattattttcagcaaagctctcaataaattgattaatagaatcttttaaaatatcaattctttttgtagagtcagttttacttataggatcagacatactccctgaaacatctaaaatcaagacaatatcaagtggtatattattcttttgattagccgcaaatacattgactggcatttgtgcaaagaacatcatgaatgtcagtatacatgctatcactttcttatatattttcattttccctatcccctttctttgaatattattcatttcctcctatgcttttattttactttttctaattgttatttttttgtaattggcgcgaaatgtcgtttttagggtgtgaaatgtatataagaagtgtttttattttgataaaatagtattaggtgatgtatatgaatatagcaatatgtgatgatgatcttttatatatgaatcaagttaaagaaatgatagaaaaatggggaaaggaacatcatgaagatgtttctatttatctttttaatcatggggatgctttaattaatagttatcaaaaaagtcatatagaagttattttattagatattatgatgcctttattaaatggtatggaaacagctcatgaaattagaaaaaatgattctgtcgttaaaattatttttttaacctcttctcctgaatttgccttggaatcttatgatgttaaagcaagtggatatcttttaaaacctacaacttatgaaaaactatgctctcttttaaatgattgtaaacaagcatttcattatgaacctgaatctattattgttaaaacagataaaggatatcgtaaaatttattatcatttgattgaatgtgttgaagcacaaaataaaaaagttttattttgtttaaatgatggtgaatgtctagaagttttagatacttttgttcattgtagtaatgaattaacttcaaatgatgcattttataaatgtcatcgaagttacttagttcatatgcctgctattgatcattttaattctatagaaattgaaacaaaaacacacaagaaagttcccatcgcaagaagttatgctaaatcttttaaagaagcttattttgaatatatgtttaaagaaggtgattaacatatgatttatactattttagaatctattcgttatactttaactttattattcggtatctttgtttctgtactatttctagatattagaatcaataaaaagaatgtcatttgtgtttttctattcttttatattgatttagtattacaaggtattttctattttactaaagatttatcggctgttatttctttatatccttttattacccatttaccacttttagtattttttgttttaattttcaaaaaacgattatttccaagtttaattgctataacaagtgcttatttatgttgtcaaataagtaactggacaacaatctttgtttcctcttttattaagaatatagataatataacctattctttaacactcattatttcttttgttttcattattaaatttgtttatttacctatttctcaattattaaaaaaacaatcacatgaacttatttcttttggtatcattccaatgttctattatatatttgattatctttctaccgtttatacaaagcttctttatattggaaataaaacaactgtagaatttacaccatttcttttatgtatctgttattttgtattctgtaccgtttattttaaacaatatgaagaaaagcaaaaaatagaaacaaccaataaggttatttatatgaaacaagcacaatcaaaaaaagaaatgaagctgatgaaagaaaatgaaaaaaagattattttaatgagacatgatatgcgtcattttttaaacaatatactaaacgatcttgaaaataatcaaaatgaacatgctatcgaatatattcatactttatttgatgccatcgatcaaactgtaagaaagaaatattgtttaaatgatactgttaatatgattatgacatcttatgaaaatagaatgaaagatgaaaatattgattttcattatcatttagatattcctcaacaattgtctattagtgatatcgatttaacttctattctatctaatggtttagaaaatgcttttaaagctgttatgttattagaaaatgaacgttttatagaattaaatatgcaagaaaaatgtggtaagttacttatatctattgaaaataattacttaaatgaacctatttttgtagatggtattcctatatctaaagaaaaagatcatggctttggaactcaaagtattgcttatacagttgaaaagctccatggaaattgtcaattttctactcatcaacaccattttaaattaagagttgtcatttaaaaaggattacaggttaagcaccttgtaatccttttacatcttgatcagtaattcttttaccatcttcaattttattaataacattaataataccattcaaagattttttattaggtttcattgtataacatttcttacctttcatagaatatgttttatatgagatttctggatctcccgtaagttgaacattgtacattttccatttagacatatcatctaattgcatttgaacaagtgattttatatcttcagatgacatattagtttcaaaacatccttctactgcttgtaaaatatttgaatagtttgtaatgattttaggagaaacagctttattgatcatggctttaagtaatctttgttggtttcttcctcgatcaaaatcaccacttggcaaagcatatctttctcttacaaaacataaagctttatctccatccatttcattaattcctttattaatatgataatgcccatgtaatgttgtaaattcataaggtgaatcaattgttactccacccaaggcatcaatgatattagtaattccactaaagtttgtcttagcataataattcacttttaaatccaagaaatcttctatagaagaaattgtctcgttaataccatacatagctgaatgcgttaatttatccatttttccatttttatgcaaggtaatttgtgtatctctaggaatagatacaattaatatttgtttttgaattggggaaacacagacagcaagattaacatcagctcttgaaattgctgaaactgtcccataagtatctattcctgtcatataaacaataaatggatttttagtcacatttgtttcttgtgtcacagaatttaatttttcttgaatttctactttatataaactctttagattttcatcaatgccttcatgatttgcttctaataaagccatataagcattatcagcaacaataacatcaatgtctccatccatgatagcatctcctaataaagaataatctttataatcttttgtctgaaaatctttatttgctttattttctattttagcaattgctgatgtaatattctttgagcctttttcactagcaattccaatttctgtattatcttttacatctcttaaacttttaatagcactctcttttttcacatacatacaaataactcttgtttgtgtaaaagaacctgtaatattagataaaaaattatttcctttaaaagccattaccgaaacaaatcctaaagcaacgctaagtattaaagataatagctttccaaaaatcaatctagcatatttattttctcgctttttctttttaatccctgatttaataagcaatgaacttaacatccataacaaaaaaataataccacataaaatcaaataatatttcattggtaacatctttaatatgtaaatacatcctaaaaaaatgatagaaacgataaattgtattaataataaaatacgtctagaaaacaacttagacataaaacttcttttcttttttttaaccattaaaacaccctcttaacatgcaaatattttagcacatcggacatacttattcaattcaagctcatttacaattaacaacaaaaaaactagatttctctagttttccattttttcttttacaggatcaatcccttttctttgtaaaatcgcatgtactacatttcttttaccactttcacttcctgcagaagtacaagtagataaagtaattaccgattgtacttgagattgatcaaaatctactttaatagaagatgtctttaccatttcttgtacaaatgaagctgtatctacaatatgtgtattatataaaacacttgtttctgaaataatatgaccaacaacaaccttatattgacttactgtaccatcaggtaaataaatataaacataaggatgttcatccgcaaagctttgatccgtataggatttaatattattaaacattgaaccatttttcatattatgaccataaataaccgtattaaaatcattaaatggatcttcattttcacttgcgataaaaatactacctgcacttaattcattatgatctatatcactatgaatataagtgtcattcgtttcgccttgtaaaacaggataattcacatttgtatttggaatttgaatccacgctttcacatctttatttctttgtaaaagctcatcccaattaatttgtaaatagctttccttttcttctttttcttctttttctttcgtataagttttagctaattctccataatcatcatctatttttttataattcaaataaatattaattaaattatatgctgaataacaaaatacacaaacacagacagttaataagatatatctaattgcttttttcattatacattaaatttaaacaacatgatgtctccgtcttgacctacatattgtttaccttcttgtctaatttttccagcttcttttaaagcatgttcactaccatatttcactaaatcatcaaaactatatgtttctgctttaataaaacctctttggaaatcactatgaatgatacccgccatttctggagctgtcattccttctttaaatgtccatgctcttacttcttgtactccagctgtaaaatatgttctaagacctaataagctataagcttctttaattaatttatcaagaccactttcttcaatacctaaatcttgcataaacatagctttttcttctttatccattcctactaattcagcttcaatttttgcacaaataggaacaacgtcgctaccttcttctttcgcaaattctaaaacttgaacataatatggattttgcattggatcttctaaatcttcttcacctaagttagctacatagattaatggtttcattgtaagtaaagtatattgtttgacaattaacatttcttctttatcaaattcaatacttcttgctggtttatttgcttctaatgttggttttagtttttctaaaacactcatttcagctttagcttctttatcacctgatttagctttcttttctaaacgtccaatacgtttttcaactgtttctaaatcagccatgatcaattctaaattaattgtttcaatatctctaataggatctacatcaccatcaacatgtgttacatccttatctctaaaacatcttacaacctcacaaattgcatccgtttctctaatatttcctaagaatttatttcctaaaccttcacctctacttgcacctcttacaagtcctgcaatatccgtaaattcaaaagttgttggaactgtctttttaggttcaatcatttctgttaatttatctaaacgatagtctggtacttctacgacacctacatttggatcaattgtcgcaaacggatagtttgctgcttctacttgtgcatttgtaattgcgttaaataatgttgatttaccaacatttggtaatcctacaatacctgctgttaatgccatctttttcactcctctttttttacctctttattgtaatgaaaaatacccataaaagcaatattttcgttttgtcattttttttcatttaaatttattttataatatcaaagaggtgattggatgttatcaacaatagatttacacggatgtagtcaaagtgaagctaaagtaaaactagatcattttttaaaaggaacttcaattcttgtaaaagaggtcactgtgatccatggatattcttcttctattcttttaaattacgttagaaaaaaatattctcatccaagaattgaaagaaaaatactgacacttaataaaggagaaacagtctttatcttaaaataatggaaaaattttatcaaaacaatctcaattacatccgtcaacatcatttagacaaaatatgcgttgtaatagctaaaataaccccttatcttacagccgcactttatgctttaacacttctcatattatttattaatcattcatcaaagctattattgacaatcattaaaccattaagttcttttttgattgtaacacttattagaaaactctataatcgtccacgtccttgtatgacatttaatattgaaccacttgtaggtcataaaacaggagaatcttttcctagtcgtcatacagtaagtgcttttgcgattgcatttgccttattgaatattaatattcatttaggaatcattgctttatttattgcatgtattgtagggctatcaagaatcatttgtgctgttcattttataagtgatgttctttgtggttttttaattgcattgatcatttatttgatataacgaaatttttatttcgttatttttttactttttttaaaaaataaaaagaaaaacatcaaaaaattgtctatataataataggaggaaaaagattcaactacttcacctgtttccttgtcttttaaggtaagtttagctccttcaatttcttttcctgttgttgcatctacttttgaaatatctacctttgtgatttcatctttcattttaactttagtcacacttccatcttcttttactgtaaatgttacatcacttgctgttgcatatcctaatggtgcaagatcttcatgcaagatatattttttacctgatacaagacctctgataatgtgaacatcttttgttgatgtccattcttccataaggttttcttcttcatctcttaatgaaagttttgcactttcaagttctttttcattagttgcatcaacttttgaaatttcagttgctgtctttttattaagaacatcaagttcttttgaatagatgattttatctgtgtgatcatagcttaagtcaatgtcatagaccttattgtttttaacatatccttctaattcttgtacttctttcaattcatattttccaagtggtagtcctgaaatatgaatttcacctaattcattagtcacataatatccgttttctgaaatatccattgaaacagcttcaccttttttataaagaagtgtatttcttccatcaagtgaataaatgtcttcttttgctgttaattggaaagtaacacctgaaagatcttctaatgtatctctgtctcttttttgtacatggatttcaccatgaggtgcaatgttcgttacattctttgtaatgacatattctttagttgttagatctttctgttcaagattgatctgatgtactttttctgaaagcacatatccttcatttgttaaagtttcccttaattcatatttgcccatgaataacgaatcaatgacaagttttccattggcatctgtttttcctttagcaacagtagctccttttgcatagcgtaaagtaccatcaactgcactgtagatattttctttggcagttaattcatattcaacatcagctagtgcttcatttgtagccttgtctgtctttgttaaaataattttcccttttggctgtgcatttttaactttgacagttagaattggatcttcatcctcatccttgtcataatctcttgtatttgtaattgtgaattttacagattgttctagttgcaagaagcctttaggtgtttctacttcttctatagagtaatctcctgcatctaactgtaaaggaagtgttactgttccttcttcgctgtcttttactgtaacaacgtttttagaattagttgtaaatgtgtcatattttttaccgccaactttttgtacaacatagttcccttttgaatctttgattttaaatgatgcaccatttaatgtgactttctttcctgattcagcatctaatttaataattttaagttgtgatgaaaatggtcggttattcacattgacacgttttacctgttcaacatctttatattcactgtaatcatctgttactgaaattgtgaaatctggtgctgtaatataatccttaggtgtctttgtttctttgacgatatattttccataaggcagatatggtgtatttgctttaccatttgaatcagttgtgatgactgcataagttgtagcattgtcccatccgacatggttaacttcactgtacaatttgaacgtgaactctgctccttgtaatcctttaactagacccgaaatgctgtctttttctcctgacttgaaaacttggatcttttgcatattcactctgttagtaccttttgcacttcttgatacttttgaaacagtttgtccttcataatcgattgatacattgatctttgcatcattgaagaccaatgagtcattcgtttttgattcttgaatataatatttccctaatggcaattcactccaagcaatctttccattggcatctgttttcttgcttgataccaatgcacctttttcatagtaagtttttgttccagcctgatttgtaatcttttcacttgcatgtaattcaaaagttacaccttcagtcgaaggggctaaacttacattaaaagacaaggaaacaggtgaagtagttgaatcgtggatttctggaaaagaaccacaccgaatcgaaggattaactgtttcaaaaacttatgttcttcatgaagatttagcacctgcaggttacaatgttgcaagtgatgttgaatttacaatctctgatacaggagaagttcaaaaagtggtcatgaaagatgaagcaaaacctgttgttgtaaaaacaggtgatgatagtaatatcagtttctatgttgcaatgggaatgtttgctttaggtttgatcgtatgtttctatgcaaaaagaaaatatggagaaaagaatgacaaataatgtctgttcggttttagcttcacttcttattctttttggagttgctggtttaaaaatatatattcaaatcagacatctgaaacagattagacagaaaatgaaggggagaaatttctcccttttttcatttgatagaaaggaagataaaaagtgaaagaattacaaataaaagagatttgccaagaaataatcgataaacagaccaaatgtaattattcagttgagtatatccttaaaaataaggatgatatcgttcgtgcagttgctgtaaataaacatacaaaaagcactatccaacttgatattgtcgatggtcgaaatcatacacagaatcttgattattttaacttcaatccagatttgtttttgtttagtgatttagaaagagaatatgaattgctttatgcaccgttgaatgttcattacgatatttggcgctattctaaagaaaatcatgaaactcttattcataaaaaaggaatgaatctttattttgatttttgtaagcggaaagatattacagaaaatacaatgttcttattgagtcttaataaaatagatatttcaaaattctatcatgaaaaaaatggctcgtatgaaatcattcaggaaatgcatatcaatgatgattcgattgttataggatacagtcctacatctccagctaaatttgttacttgggaaacaaatggaaatagaaaatatggattttatacaggacattattttaatgattatgaagaagcatataaggatatggagaaacgttcaaaatatttacttgagcagaatctgtgtagaaaaaggaactttttaagaaaaaataaaataaatcaagaaaggtaggtgagatgaaatgaataaactagatacattatatgaacttcttgaaaaatcatgtcatgatattattcaaagtgaggaatcatggctttcatttttaaaaacatccggctatctttataattttaattttaccaaccaactattgatctatcagcaaagacctgatgcaaaagcctgtacggactttgaaacatggaataataggatgaacaggtggatcaaaaagggttcaaaaggtatagcacttatagacgatggtggtcgatatacaaaaataagatatgtttttgatattgctgatacaaggagtccacgtaatagagaacttcatttatggagtgtacaagagtcgtttcataaacaattgattgataaaattgcaaaacaatttgatatgacttcaaatgatgaggatttaggaagtttcatcaaagaaattgcaaaggaacagacaggctattatgtggatgattattttaaaaggttgatgaaattaaaagacggttctttgctagaaagctatggggaaaatgaactaaagaatctttatagaaatcttttagaaaattcagttgcctacagtttaatgagcagatgtgatattgaaacaaaattttattttgaagcggatgattttatatcaatagaactttttaatacacctgaaatgttgggagtaataggtaattcctttcaagaagaaagtaattcacttttaaatgtgatttctcatattacaaaagaattgataattcaaaatcgcacatttgaaaataacaatcgtttagtagatgataaaattgaaaaaaatgaagggagtgttatcaatggaacaaatcacatactcaacagtgggagattatcaaatgcccaatttgacagtagacaaggagatacctttaggaaaatacgcaatgatgaagaaaaagtatctgaaggaacagcagccagagattctcttttcacttcgagtaaggaatcaactgaactcttacttaatggaaacagagaagaaagcaaacgagatgatagaaatgttgatgaaggaattgttaacgaaaaatccagcaccaaacaaagagatacatcagatggaatgggtacagcatatgaacaaccttcaaaaaacagcggaagaaatcattctgaaggaaataatctacaattagatttaggaattgaagaagtcgataaggaaaagggtggcgataatgtattgccaccctttgatttaagtgatttacctcaactcttaagagaagatgtttcattgcaacatagcaaagaagaaattattcagtattttcatgagcatacagatgaaattgaaagggcaaattatttaaaagaatgttatgatgatacgcttgttcaaacattcaggtgtccagaacattatgactatagttatcttggatataaaaaaagaaatgatggattggacatatggagtggtaactacttgaatatgaaaagcaaatcgtacttgtctttttttcaacttcaaagttatcttgcaaaaattattgaaaaagatgaatatcttacatcgccttatgaaaatgaatcaggattaaaaagggcatatggaaacaaaatcatcaatgcaaatgttttttatcatgtttttcagtataacgatgaacttttagaatctgcaggaagaatcattgagttttttcaaacacatgacagtgatgaagaacgttgtgaatatgttcagcatatatatcctgacagtataagagaatggaaagttgatgacgtcattcttggatatgacagattagatgatgggttgcatatttatttaggaacttttgataatcaagttgtttcttatgattattcatggaattttgttgctaaagaaattgatggcatgatattatctcgatattttgcaccagatatacagattccatcactggaggaacaaaaaaatgtagtatatgagaatattcaaaattttgaaaatggaatctatttttcacaacaggaaatagatagagtattgactcgtggaagtggatttgaagaaggcaaataccgaatcaatcaaatgttttcaaaaaatactacattgaaagaaaaggttcagtttttaaaaaaagaatatggagagggtggaagttctcctgcagtaggttttataaatgtcaattatgatgctaagggaatgagtttaagtcgttatcgtgagattggaaaagatgaaatcaaaatcactttaaaatgggataaggttgctaaaaggatagatgaacttattcagcttgacagatatcttaataaaaaagaaaaagaatattatccaacattcttgcaaaatcaacttcaacatcaactcgaatatgaaaggaaaagtattaatcaaagtcttatccctgaatcttctgatgatttacagaatgaaaatattccaaaagagtatcaatggaacttgggagacagcgtatatgttggagcaacagaatacaaaattattgaaagtggtaatgaaataactttacaggatgaaagcttcccattgtttttagaatattattctaaagatgattttctcaaattgttaaaagaaaacccattaaatgaccatttgttaaaaacaataacacaggaagttcaagatataaacattgatagttcaaaccgtgcaatcattaagaggtaccttcctgaccttgaagatcaaattaagcgttctatgatttatcccgcattacgtgatagtgatacaacagatgaagaggcagaagattatattcgagaagaattgatttctattatgccttcttatgaaacgaaggatcccgatttttataacagatatcttaatgatgatgattttagaaaatcgcttgttgattatttgattgatagaacttatgaagattattcaatatctaatgatattttcaataaagaaaatgaagaaaatagtcagttgtttgaaaaaatgaaaaaaatagtaccacgtattatgaatgaagtctctggtttttgtaacatgataactgcaagtgacaatgatgatcctttgatgattttatatgatcatgatgaaaaaacaatagacatgttccactattatgaggtaaatggtatagaagtaagtgagccttatatgacctttaaagttgacttttcaaaagaactgttagagccgatttcatataaaaatgactcaattgatattgaaatttcttctgataataaaaataaagacgctttatcaaccaaagatgatttagaaaattatgcaaatcaatggcttgataaacttttagaaaaaaattatatagttgaatccgagcgggtatttaaggatagcattaacaaaagagagatttatcatatagattatgatagctcttttattgtttatactgacatgccttattctttagtaaaggagttcgcagataattataattatattgtctcagataagattcaaaaagaagatattttaattaatcctgttcaatctgaaaagataaattatcaaatcatggataaagatttaggtaaaagaactccaaaagaaagatacaacgataacgtagcagcaatcagactgcttttttctttagaaaaacaaggaagaaatgcaacaaaagatgaacaggatattttgtcacgatatgttggctggggaggattagcagatgtttttgatgaaagtaaatcgaactgggctaatgaatatcttgaactcaaatcattgttgagtgaggaagaatataaaagtgcaagagaatcaacactgacttctttctatacttcacctgttgttattgaaagtatctataaggcattgaacaatttaggatttagacatggtaatattttagaaccatcatgtggtattggtaatttctttggtatgcttccagatgaaatgaagggttcaaagatgtatggtgtggagttggattcgatcagtggtcgtattgcaaaacagctttatcaaaattcaaatattgcaatagaaggttatgagaaaactaagttaccagatagttttttcgatgtagctgttggaaatgtgccatttggaaactttaaggtcgtagataaaaaatatgataggctgaatttcaatattcacgattacttttttgcaaaaacaatcgacaaggtaagaccaaatggaatcattgcttttgtaacttcacgttatacaatggataaaagaaacagtaatgtaagaagatatatcaatgaaagatgtgaacttttaggtgctatacgattacctaatgatgcttttggtgatacaaaagcggtcagtgatattctatttcttcaaaaaagagagcgttctgttttaaaagatgatgattgggtttcaacagggataacagaagaaggatatgtcatcaatcaatattatattgatcaccctgaaatgatcttaggaacaattgaaaaaactcatgcaatgtatggcagagaggatataacggtcgtaggatatgatgaacctctcaatgaatcattggggaaagccatctataatatcaaaggtcacatagatgaagttgatattgtggaagaaaatgaaaatgagattgaaagcatacctgctgatccacaaataagaaattattcctatactgttataggtgataaggtctattacagagaaaattctttaatgaataaagttgatgttggtgatacaacatttaaaagaataaaaggcatgattagaatacgtgatactgtcagagatttgattacctatcaaagtgaagattatccagaggaaatgattgctaaaaagcaaagagaattgaatgattactatgatgtttttactcaagcatatggtttgctcaacagtcgaggtaataccattgcatttagagaagacagttcgttctatcttttatgttctttagaaaatttaaacgaagatggaactttaaaatctaaagcagccatgtttactcaaagaacgattcgtaaaaagaaagagtttaacaatgttgctacagctaatgaggcattgatggtgtctttaagtgaaaaagcaaaagtcgacattaattatatgagtgaattgacgggcataagtaatgaaaaaatcaaagaagatttagatggtatcatatttaaagtccctagtgttttaaatgaagaacaggaagaatatgtaacagctgatgaataccttagtggaaatatcagagaaaaattagaagtagccaaaatgtcagcagcaattgatccaaagtatcaaaagaatgtggaggctttagaaaaggcaatgcctaaagaacttacagctagtgaaattgaggtcagacttggggcaacttggattccagtagaaatctatcagcagtttctttatgaattgcttgatacacctaactgggtaagaaactatacgaagctttcttattcttcttataatgctaattggaatatcagtgcaaagaatatggataaagaaagcgtaaaagctgataagacttatggaacttcaagagcaaacgcatatagattgatagaagattgtcttaatttgaaacagacaaaaatatttgattatgaatatgatgatgacggtaataaacaagcaattcttaataaaaaggaaacgatgattgctcaacaaaaacaggatacaatcaaagaaagcttcaataattggatttggaaagatcctcaaagacgtgaagaattaacacagatttacaatcgattattcaacagcataagaccccgtgaatataatggtgatcatttagagtttccaggaatgaatcctgaaattactttacgaaaacatcagaaagacgccatagcacgtattctttatggtcaaaatgttcttcttgctcacgtagtgggggcaggtaagacttttgaaatgacggcagcatgtatggaattaaaaagattaggtttagcacaaaagccaatgtttgttgttcccaaccatttagttgagcaatggggagcagaatttttgcaactctatccaagtgccaacattctagttgcaacaaaaagagattttgaaaagaaaaatagaaaaaagctgttttctaaaatggcaactggtgaatatgatgctattatcatagggcattcacaatttgaaaaaatacccatgtcaattgaaaggcagaagatgaatattgaaaatgaaattgaagaaattacaaatggaataagttctttaaaagcaaataatggagaaagatttacaatcaaacagttagaaagaaccaagaagggattaaaagcaaaactcgaaaaattgaataagaatgatagaaaagacgatctaattacttttgaagaaataggagtggatcgtctttttgttgatgaagcacatttttataaaaatctttttctatttacaaagatgaataatgtatcaggactttctacaacagatgcacaaaaatcttcagatctttatttgaagtgtaggtacttggatgaaattacaggaggaaaaggggttgttttcgcaacaggaacacctatttccaactcgatgacggaaatgtatacgatgcagcgttatttgcagtattccactctagttaagcataaccttcatcattttgattgttgggcttccacttttggagaaacaagcacgagtatcgaacttgcccctgaaggttctggatacaggatgaagactcgtttttctaaattcttcaatcttcctgaattgattaatatgttcaaggaagtagcagatattaagactgctgatatgttgaatcttcctgttcctaatgctcattaccaaaatgtggcagttaaaccttctgatattcaaaaagaacttgttgaaagcttaggtgagcgtgctcaaaaaattagagatggaacagttgatcctcatgaggataatatgcttaaaattacgaacgatggaagaaaattggcacttgatcaaaggcttatcaatgaacttttaccagaaaataaaaatagcaaggtcaatgcctgtattaaaaatatattgaagatatatcatgaaacagtggaagaaaaaagtacacagcttgtcttttgtgatatgtctactcctcgtaatgatgcattcaatgtctacgatgaaattagaaataaactattagaagaaggaattcctgaaagtgaaattgcatatatccataatgcaaaaacagatgttaaaaagaaagaactcttttctaaggttcgagaaggtaaagtgagaattttgattggttcgacaggtaaaatgggagctggaacaaatgtacaagaacgcttgatagcaatacatgatctggattgtccttggcgaccttcggacttggagcaacgtgcaggaagaatcgtaagacaaggaaatagaaataaggatgtttatatttatcgttatgtaacagaaggtacatttgatgcttatctatatcagttggttgaaaataaacaaaaattcatagggcaaattatgacaagcaaatctcctgtaagaagtgcagaagatatagatgaggcttcactttcttatgcagagatcaaggcactagcgagtggaaatcccaaagtgaaagaaaagatggagcttgatacaaaagtatccaaactaaagctttccaaagcaaactatctctctcaaaaatatgatttagaagatagaattattaaatattatccacagaagattaaatccattaagacaaggattgaaggactagaaaatgatacaaaagatttgaaacctcaaaaagagtttcagcaaataaaaatcaaggatatgttgatagtagataaaaaacaggcaggaaatgcaatacttcttgcctgtaaggaatatgatggtcaggataaaaaatacattggggagtatagaggatttgatttgtacattcagttcaacagtttaagtcaatattacatcatgtctttaaagaaagaactttattatcctgttgaactaggaaatgatgtttatgggaatcttacaagaattgataatgctattgaaaatattccaaaaagtttaaaagtggaaagggaacttcttcaaaatacattgcaacagctacataatgctgaacttgaagtaaaaaagccctttgaaaaagaagatgaattgaatgatgctttaaagaaactgtccaaaatcaataaagaacttgatttagataagaaagaaaatattccagatacttctgttcaaaaaaacgatacagatgttggtcgtaagtcaaaagggaataggatacgataagtatgtcaaataagttttacacagatgaagaggcacaagaactacaaaagctggatgtgtttacttatttgtataattatgaaccaagtgaacttgttaaatctggaaaaaaagaataccgaacggcaacgcattcctctttggttatctctaatggaaagtggatatggttttctcaagggaaaggtggggtaagtgcaatcagttatttaatggatgttaaaggtatgaactattatgaggctgtaaaatatgttgataaatgtataagagatagtcctcctgtttatcatgtaaacaaatgttcaaaaacgaacaatggtattttcaaattgccacccgtttcaaaagataataaaaaaatgatgtactatctaaaaaataaaagaaaaattgataaagaagttattcaattttattatcaaaagggaatgatctatgagtgtagttatgatcactctgttgtctttgtaggatatgatgaaaaaggaatagaacgttatgcttcaaaaagagcaacagatggtgattggaaggtagacgtatttaacagtaataaggaatacagttttcaattggtgaataaagaaagtgatgttttaaatatttttgaaagtgcaattgaccttatgtcttttcaaactttagagaagttgcataaaaggaattggaagaagaacaattatctttctttatcaggagtaacagcaataggtaattctattgaggaaagtgaattgcctattgccttaggtaaatttttagaaatcaatcctcaaattaaagttttaaatctatatttggataatgatcaggcaggaaaaaacagtattgaaaagatcaattatcttttaggtaaaagctatcaaatctatgataaaggacctaaaaaaatgaaagatgtcaatgaagttctgacaagaaaatttaagcaaaaagaagaatacagtagataggaaggtcatggatcaaattcgtgaccttttattatgcaaggagaaaatgatgaaagaatatgttgttgaaattacagaagtattacagtatcaagatacagtaaaagctcactctaaaaatgaagcaattaatgctgtaagagaaaagtataaaaatgaagatgtaatacttaatgatgaaaatataacggatttaggatttgatgttcttgaggtcaagaaaaaactttttgacagggaaagatagttttccagcaggataataaattcattaaatagaagtattatcctgttgatgacttttgtagcaagcaaggacttttgtacccaaagtcagcttgttagggacaatccctaagaccctacaggaaatggagtagataaaattgaacaagatcaaaagaaataaagagataaaagtaagattatctttgattgaattggaaaatttaaatgagtgtgttaagaaaacaggactgtcaagagaagaatatattcgtacattgataagtggatatgttccatcaccaaggattagtgatgacgtcaaggaaattatcaagcagttgagaatgataggtaataacttaaatcagattgcagttattggttataaaactggaacaattgatattttaaaatataagagaaactgttcagaacttgaaaaaaatgttcaattaatattaagcaatgttactgaacctacaaggatggaaaagtaaaatggctacaacaagtatatgggcagttaaggataatttggacagggttttaaattatgcttctaatcctcttaagacaaaagaaacggatagtggttatgaatatgaaggacttgagaatgttattgattatgctgtcaatgatgataaaactgaaagacaactttatgtcagtggtttaaattgtcatccctcaactgttcttcagcaaatggaacagacaaaaaggaatgcacacaaggaggatggtgttttagcatttcatgcgtatcagtcttttttaccaggggaggttacagctgaaacagcacatcaaattggattagaacttgcccatcagatgtggggagatgattttgaggtattggtttgcacacatacagataagaaacattttcataatcactttgttataaattctgtttcatggacaacgtacaaaagatttttaaacaaacacgctgactatgacaaaatgagaagattgtcggatgcactttgtgaaaagtatagacttaatgtaatcacagatcctaaaaagggagtgcactattctgaatggcaggctaaaaaacagaaaaagcctacacgaagaacgcttatagaagatgatcttgaacgtgctattgcatcatcaagaacattcacacagtttttacaatatctcaagtctattggatatgatgtgaaaacaaatgtaaaacatattgcagtcaaaccacccggagcacctcgtttttttagactttataaagtaagagatgatggaacatacagcgaagaaaatatcaagaaaagaatcattgaacaggatctatattttgaaaaaagaacacgaatcaaaagtaaatatcaatatcatggaaatatcaaaaaggcaaaaaagataacaggaataaaggcattgtatttccattatatgtatcgaatgggaattatccctaaaaatgtaccttctagaagtaaggtacattttatttttaaggaggatcttagatatatggacaggattactgaagaaacaacttttctgtgcaaaaagaaaatcaatacgatcgaggatttggaaaattatgaaagtgaaataagcaacaaaattgaaaagttagtcaaggaaagaagatgtctttataacaaggtcaaaagatgccgaaatcttgaaagaaaagaaatgattcaaaaagatatcgaaacaatttcaaaagaaataaaggattatcgaaaggaggtgaaattatgtgaaggtatcaaacaacgttccttaaagattaaagataaattacaaacagttaaggaacaagaaaataaagtacaagaaagaagttcaaaagaacgaaaaagaaattattaaggaaggaggaactttatgaatgctggcggagaaacagccgatcaagcagtgaggatgacactgcagggaatagaaatggcagctaatgtagctttaaaggcaggtggaatggcttctaaatctttagcagtaacactttatgcaattttaacagataagaaaaaggttaaaggaaaaacaagactagctaatatgttgaaatctggaaaggaacttaaagtgtttgctgtacatcattcagatttgaaaaagttttgtgaagaagcaaaacgttatggtgttctttattctgtattaaaagaaagaaataatacggatggaatatgcgatattatggtacgagctgaagatgcagcaaaaatcagcaggatcgtagataaatatgaacttgcaactattgatactgaagcaatgagaaaagcagcacttgcaaaacagcctgatgaattcaaagatgtcaaaccgttaactgaaaaagaacatgatgagttggtatcttctttattggattcaatgaaagaagagcaaaacccgtctatggctcgaacgaaaacgagaggcgaaaatcagttcgagcatatctcaatggaggaaggtatcaataaaagaccatcagtaaaaaaagaactagatgagataaaaaatagaaataaaaaggctaaacctaaacaaacagttagacaaagaaatagggtacgtcataaacagcctcaacgtaagaaaaagataaaaagaaaggtaagataaaatatgagtgatatatataatttattaaacaatacaactgatgagaaagttgaagaaaaacctagaattcctccagaggaatatgccaaacaaaaacaacaaaaaagacagaatctttatgatatggctgagaagcaaacacatgaagttgtttcttctccacaaaattatctgaactatttagaaatgcaatcaaaatttggttatactgttactaatacactcttggtcatggcacaatgtccacaagcaacactgttaaaagataacaatcgttgggtagaagaaaaaaagtatgtaaaaaaaggagtaaaaggaattggaatattagaacctaaaggtgaatatcaaggaaatgatggcgtgataagaactaactatgatgttaaatatgtttttgatatttctcaattaaacagaccatacagaatgaaaaaacaaaatttgtctgttagagaaatcatcagcggtttagtttatcaatcacctgttaaaatgcaaatggttgacaatactgaaaatggttcgctagtacaatactctccagataatcaaatgatctactatgcagacgggatgagtccgacagatttaatggaaggtttagcaagggaatattgctatgtagaatttgaaagccaatatggaaatgttgacagaacagaggatgcctttatggtgaaaagcgctgcctatattctttgtaaaaaattgaacattccagtttcaaacgttgatttcgcaaatgaagtaaaaaattattttgaaggaatggattctcgagataccaaagaagaattaagcaatattaaaagtattgcagatgaagtgagcaatcgagctgaaagaggaatctatagattgcaacaggaaagagatagtgcaagcagaggagaagaacgttaatggggttatttaagaataaagaaccaacggttttgattagagtaacggactttgaaagaagaataattattactgctttaagaaatttaagagacaagcaaataaaagaaaataaggattatgattatattgaatcgattatggacaaggcagcaatagctgacatatccaaatcaaaaaaatcatatgaggaaagataaacaggttgaacttgttttttattttgtaggagcagtatttatagcgtggctttcagttcttgttgctccttgcatccatgagggactatttgatgcaatcatttacttaaatgaagcaatgaatagccctttttcttttgaattatgtcaggatactcttaaatgtatcttgatatctgaatcaatctattctttttcatacttgacttattactataacaggaagaattatagaagaaatgaggagtatggttcggcaaaatgggcgaataacaaagctgtcaataaaaaatatgctgaaaaggactactattccaataagatactttcacagaatgttcgtattgggttagatggcagacgacatagaagaaacctaaatactttagttattggtggaagtggagcagggaaaactcgattttttggtaagcctaatttgatgcaatgcaatacatcttttgtgattcttgatccaaaaggtgaacaactcagagatgtaggaaatcttttagaaaaagaaggatatgttatcaaagttgttgatcttatcaatatgaacagatcacattgttataatccgtttcgctatatcaaggatgataaggatgttttaaagcttataactaatcttataagaaataccacacctaaaggtagtcaaacaaatgatcccttttgggaaaaatcggaaacggctttattagaagctctttgtctttaccttttacatgaagcaccagaagaagaacaaaatttcacgatggtcatggaaatgattgcagctgctgaagtaaaagaagatgatgaagaatatcaaagtccgctagatgaattgtttgaaagattggaaataagaaatccaaattcattagctctcaagcaatataagatttataaacaggcggcagggaaaactgctaaatcgattcttatttctgtaggtgtgcgtttatcagcttttaacttggaaagtattgctagtttaactgcaacagatgagttggaacttgatttggtgggagaaagaaaaacagcaatctttgcagttattccagacaatgattcaacattcaattttcttatcggtatgctgtatacgcagctttttcaaatgttgtattatcaagcggatattgttcacggtggtgcgttaccagtaccagtacattttcttatggacgaatttgcgaatgttgctttaccagatgaatttgataaattactttctacaatgagatcacgacttatttttgtttcaatcattatacagaatcttgctcaaatcaaaggactttataaagacagttgggaaagtatcgtagggaattgtgatacattatactatcttggtggaaatgaacagagtacacacaaattcatgtccgaatatttggggaaagagacacttgatacaaatacttacggtaaatcaagtggaaggtcaggaaattattcaacaaactatcaacaggctggaagagaattacttacaccagatgaggttagattattagataatgattatggattgctttttattagaggagaacgacctgtatttgataagaagtatgatattttgaaacatccaagaataaatgaaactacggatggaaatgcaaaaccatatctgcatggtaaaatcaaatattcaattgatgactggcaaaatattttattgagcgatagagaatatgaattattaagtgatgaagatatggacaactattttaaacaattaaatagtaaataggaaagtagctttagaaatagagctgtttttattttgaagggagaaaaacaaatgagaaaatatttaaaaaaatacaaaagaacaatgaagatattttttgtttatgcactcaatatctttttaatgaatttcaaggtaattcaagtttatgcagatggagatccattaacagttgttaataatctttcaacttttgtttttagtttaattagagctattggaatgatcattttagggtttggaattgtacagttaggattaagtttaaaaagtcatgatccatctcaaagagcaaatggatttttaactgtagcaggaggtatcgtcattacctttgcaaaagaaattttaaatacaattacagggtagtgattttagatgggtaaggcaggtgatagatattgggtagtattattgataacttaacaaacgcaatcaatacatggaatgagaaactcgcagaaatatggttgttactaacacagacacctcaaaactttaaaggcggaaatatttggaatgtgattgtgaagatacatggaggtttgcaagctattggacttgcacttcttgttcttttctttgcagtaggaatggtaaagacatgcagtaatctaaacgagataaagcgacccgagcaggcaattcgtttgtttttaaggtttgcaattgcaagaggtctggttgtttatgggatggaattgatgacaaaattatttgagattgtgcaaggtataacctctcaaattatgacaacagtaggtgttggaacagcaacatctactactattcctcaagaaatcatagatgcagtagaggattgtggctttttggaaagcatacctgtttgggcggtaacacttttaggtggtattttcattacgattttgtcctttgttcttatacttactgtttatggtcgtttctttaaattgtatatgtatacggccatttctcctgtaccactttctactgctgcaggagaaagtacacagtcagtagcgataacgtttattaagtcttatgtgggtgtatgtttagaaggagcaattatagttttagcctgtattattttttcacaatttgcggggtcaccaccagctgtagacagtgaagtgagtgcgatttcaatgttgtggagctatatcggagaacttattttcaatatgctgattttagttggtacggtaaaaatgtcagatcgaatagttaaagaaatgatgggattgtaatactttaatctaaaatgttgaatatatagtattataagggtataatattactagaatattactatattggaggtgcttattatgaatattcgtccatctgcagcaattagacaaaattataatgaaattgcagacctttgtaggacaagtcaagaacctgtatatctcacaagaaacggtgaaggtgatttagttgttatggatatggagacatttagtcgtagggaaaaaatgttagatttacgtgaacaacttctttctgtagaagaagatagaatggcaggaaataaagggtatacaattgatgaattagataaataccttgatgatattatttcaggagtatagaaaatggaatatgagaaatatgaagtaattatttcagaaaaggcaaaaaatatgcttgcatcaaatattgcttttattgctaaggtaagtgctgatgcagcaacaaaacaaaaaaagcggttattgatggtatacgatcattagagcaaatgcccaaacgctatcctttttttaacgaagaatatataccaccaaacaaatatagaaaaatgtttataaaaaaatggtatttgattttatatcaaattcaagaagatgttgtatacgttgattatatacttgattatagaaaagattatcaatggttagataagtaaagagttaatggcaagagaaatttcctcttgctttttatttgtgaaaaaagaggaaggagtaatatggaagtaaaaattaataaagagataagagaatatacagaaggcattttcttaggattatccctaagacaatgctttttttcttttttagcgtgtgtaatggcagttatattttattttttattcattgatcatttaggaatggagataacaagttggttgtgtatgatttcagctgcaccatttgcagcacttggattcattagatttcaaggaatgaatgctgaacagattgttgtatgtgcgatacgctcactattgattaaacagcataatttgatatttaaaccacaaaatttatattacgaatatttaaaagaatttttagaaattaaaagaaaggagtctattgatccaaatgataaaaagctacgaaagattgaaaaaacaaaacaaagaaaaaataagtgttcccaaaagcgcacaggatctaattgatattgatactatctataaagatggtattttttgttctaagaacaaatattctaaaacatataggtttaaggatattaattattcaattgcttcaaaggatgaaaagattggattgtttttaaattatagtgaattgcttaattcattagatagttcaacaatgacaaagattacaatcaataatagaaaaattaatataaaagaatttaaagaaaagattttaattccattaagaaatgatcatcttgataaatatcgaaaagaatacaatgatatgttattagagaaagtatctggagcagatggaattattcaagaaaagtatataacaataactgcctttaaaaagaatgtagaagaagcaagaagcttcttttcaagggtaactgtagaattatcatctcatttttctaaattgggttctcaattagaagaacttgatgctattgaaagattaaaaattcttcatgatttttatagaaacggacatgaagaacagttttcatttgatatggatgtttcaatgagaaagggacatcattttaaagatgctatctgtccacaaatgccaaagtttcatgataaatattttcaattaggagataagtatggaagagttatgtatttaagtgagtatgcaagatatgtaaaagacagttttatttcagaactttgttcattaaataaaaatcttatgtattcaatggatattattacagttccaacagatgaggcagtaaaagaagttgaaagaaaatggcttggtgttgaaactaacatcgcaaattggcaaagaagacagaacgctaataacaatttcagtgctgtaattccttatgatatggaacttcaaagaaaagagagcaaagaatttttagatgatttaacagtaagggatcaacgtatgatgttgggatgtttgacaattgttcatttagctgatagcttagaagaacttgataatgatacagaagcacttatggcagttgctagaaagtatatgtgtgaattggatatattgttttttgcaagtagacagctagatggcctatcaagtgttttaccaattggaacaaataagctaaatattgtaagaacattacttacagaaagcatggctgtctttataccgtttagagcacaggaagttgttgatgatggtggtatttggtttggacaaaatgctattacaaataatttaattatgtgcaataaagaaaaattgatgaatcctaatgcctttcagttaggagtacctggttctggaaaatcctttttaacaaaggaacaaatcgtatttttagctcttgcaactcaagatgatattattatctgtgatccagaagcagagtattcacttttagttaaagagttgggaggagaagttattacgattgcagcaggaagtgaaaatcatattaatgcaatggatatgttagaaggttatggtgatagtggtaatccaattggagataagtcacaatttatcatgtctttatttgaacagttggatagagatggaattaaaccagtagacaggtcaattattgatagatgtgtaactttggtatttcaggattattatcgaacaagaaaaatgcctacacttgttacgttgagagagaaattgttagaacaacctgaaatagaagcaagaagtttagcattgaaacttgaattgtttacggatggctcattagatgcatttgcacatcaaacaaatgtaaatacttcaagcagaattgtatcgtatgatatttttaagcttggaaaacaattaaagacaatggggctattagtaatcacagatgcaatgattaaccgtgttaatgaaaattggcgaaaaggtaaaaggacacatatcattcttgatgaatttcatgtggtttttgaaaatgaagagagtgcttctttctttaactcggcatggagacaatttagaaaaagagatggctatcctattggaattacacagaatgttgaatatctgttagatagtgttcaggcaagtacgatgctttctaacagtgagtttgttgttatgttaaatcaatcatatcaagatagagaaaagcttgcaaaattactgaatatctctgatgagcagttaagttatataactaatgcacaatcagggtgtggacttattaagtatggtggaaacatcgtaccttttataaatagatttccaaaaaatacattgttatataaattgatgtcaacaaaaccatcagaaaaaaataaataatattaatataagcgaaatgatataaatacatatcttttcgcttttcatgaaaggagaaaccattatggataaacaattaccagcaatatacaatgatccttatattagtgaatattttaaaatactttataaggaacataaagaggataaaataaatgaaactaaagaattactggattatatttcaaatatggaaaagaaaatagattatatgacaagtgaagtcttagaattaatgaatacaatagaacaattacaaaatccaactattcgagaaactatgaaaagtataactgaagatataaaaaagacagtagataatggaaagaaacaattaagtgaaataaaatcaaatgttctatcttcagtaaaagaatgtgtgaatcaatttaaacaacatggtaaacaggtagttatcaaaacaattaaaatttcacattttaaagtggctcttggaaaattccataggtcactttttaaatgtgttaataaaacacatctacttataaataaatgtgatgctgttactaacgaattaagaaatacaaagatgaattttaaaaatatcggagcaattattatggggaagcctccagttaataaaagaccagaagtgaataaaatgaattttattcaaagaacatcacgctcaatgctgtctaatttagaaaaaatgattgtaaaaacttcaaagatgattcatcgagtggataatatagataaaaagtctgtaaaaagtgaaataaaatatttagaaggcaagacgacagaaaagtcaataaaaaataaaatgaaaaaaaataagatagtgaggggaatataatgaagtatttcaacaatgaacataaaaaagcatatcatttagctatagaaaaaagtggaattaatgatgtttatcatcaatcgctattttatacattaaccattgataaagattgcagagagcatattaatgatctttatgattttaataggaacagtattaaactgtcaggactagataaatcatggcatacttcaggatcaattaatacagcattgatgggtttcaatttgttcaatggttatgtagatgaaaaaaatgcaaaagtttcaacaccttatgaactgttttcatgtgaatacagttctttttttatggagtcaataaaattaagatatcctgaatattataaatctagaaaagataagatttttgataactgtttatgataaagaatattaagacaaaagaaacaattaaggatattaagactcttgataagaaaaagacgctagattcttttaataaaaagcaaagtatcaatacaaaaaataatgtacaggatgaaaaggaaaataaggagtcaaattatgcaataaataaaatcgaaggtacaagtgaaaaaacacttgttagtgctagaataaaaataaagaaatatcgaaaccaaaaaagaaaaaatgaaaagcttataaaagaatacagtacaaaaaagggtaatatcaaattaaaaaacataaaattatcaacagctaagaataaaattaattccagaacaagtggtaatttagcgaacacaattaatcaaactttgtcgaatcagacaataagtcaatcaagaatgttgaacaaatatagaaaatcattaaataagttcaatggaacaaccacgatgaaatattcaggtaataaaattatagattttataaaaaagctgataagttttgtaaaaaagccaatagcaatcatgaatcatttgatttcttatggaacaggaatgattattctaatagtgattgttttatttattggagtattttctgctttgtcagatgattctagtgtaaatacgtctgtagaaggacttagttcagaagtaatagcttatacaccagtgattgaaaaatatgcgttggaaagtgggattggtgattatgtttctttgatacaggcagtaatgatgcaagaaagcggaggaaagggaaatgaccctatgcaatcatcagaatgtggatttaatgaaaaatatccaagggtgcataatggatcgaaggagctaaacttaccttaaaagacaaggaaacaggtgaagtagttgaatcatggacttctggaaaagaaccacaccgaatcgaaggattaactgtttcaaaaacttatgtgcttcatgaagatttagcacctgcaggctacaatgttgcaagtgatgttgaatttacaatttctgatacaggagaagttcaaaaagtagttatgaaggatgaagcaaaacctattgttgtaaaaactggcgatgatacagactataaatcattgagtgcgttactaattgctagtggattattaattgcagcagtgatttgtaaaatcaaaagaggtaaagatgaataaaaaggattagataatttcaaattcaattaatttaaaatatttttaacaatatgagtgcaataaatacagtttgcgtgcaagttgttgaatgtagcagaagatatcataaaatataagtaacaaagagctcttaaataaaaaaatggaggaacaataaaatgagaaaattataaaatgagaaaattattaattagccttttttcggcaagtatgttattaagtgggataacttctgttaatgcacaaactgtatcaaatgatgttacagttcaaacatatcaagaagtaatcaatggagtagaatgtgatgttactacttatgacagtgataatttatataaagttaattatcaagattcaacaggagaaaaacatattgggattttaaataaagatactaaagaattaacggttgacggagatgttatagaatattcagttacttcaggaacacctgttttagcagattctctctctatatcaacatatgctagttctgattggacaccagtgctagttacaaaaggtattaaagtaagctgttcaccaatttttaaatcattagggtatgttacaacagcaattattactgcggctggaaaaactgttggtgctagattaggtagtgcaaaagtaggagaagtagtaggtaaggctcttggatcagctgcgagagatgctgtaagcaaagttaatgttacttttaaatatgatttgtatagaacaaaaaatcctgtatatgtttcatcaaatgcatcagtaaaaacaacaggatacagatatcaaaattatgctatgaatgcaacatataaaggaaaaactttttcaaaaactactacggtttgtggtagctggtggtcatcaagcaatccgtattaaagattggaatatttttataatccatagtaaaattgaatatgggtgatgttatgaaagttgtaataattgatgatgatatcaattttgcatataaattaaagaattatcttataaaatttaacactatttcttttgacatagagatcaacaattatgataaagaatttgaattatactttttagacatagatatgccagatatggatggcatatcttatgctagaagtataaaaaagaagtatcctctttcacgaattatatttgtttcttatagaagcgatttagtatttgatgcaattcaggtattcccattttcttttgtaagaaaggaaaaaatgaatgaagaacttccaatggttttagaagaaatttgtgaactagaaaaagataaaaagaagatgctaaagataaatgaacagttttcgctgccggtaaataggatatgttatatagagaaaagaggttcctatgcacatatttatacagaaaataacgtgtataagttaagaaagtctttaagtaatatatttgattttatgaacagccattttgtttacattaataaaggtacaattgtgaatatgaagtatgttaatgagtaccaaaaagaaaacattattttaaaagacgggacaatactatatatgagtcgaggtaggcgtagtgaatttatgttatcttatcttaaatacaaggaggagatatagttggaatatctatacattgtatttttaactttatttatatctatatgttgtttgaagtattttgatgtgacagttgacaagaaaaatattctattggtgattattatttctctatgctgctgtatgattaattttctcaaattgcctgatatgctaaacacagtaattagagatagcttaatatacttgtttattagaaaatatatttcaaaagatagagatttggaaatagtatcaattattttggtattagaaacaattgcaaaatgcagctattatttatttgttttgtttgttcccttaattattcaagcaaatatatcaaatattcttttatatagtaattatgagcttaaaattttaagtttgtttattttatttgtattaatggtaatgtattttcgttcatcatattttttaaatgtaagatgtaacagaataacttatgccttattatctacttgttcagtaatttctttatatggattagaagttattccaacattaggaaatcaaataaaagaaaatcaattatattttctcttactttcttttatgtatattgttgtagttaatataatcatttatatttatcataatcaacaaacacaacaagaaatagaaaataaggttgttttagaacaggctagaattttgaaacaagaaaaagatattatttctatacaaaataaaatgattgaaaacattaaacatgatcttaattattttaaagaaatggtaaatgacggtgctaaagatcatttaaatggaacaattaagaaaattgataaatataatagtaattttatttttgaagattatttattaaataattttatttcaagaatgaaaactgaaatgaaagaaaataataaagatttaaagttaattatcacaaatacaaatatatcgattgatttaacaatatataaccagctcatttctattatggaatttataatccaaaacagcttggaaagatttatccagtttcgtatacactctttagaaaatatgtctatttttgaatttacgtatatgccaaagaataaagacgtaataaaatctaaagatataaaaaataatgaaaatattgtttttaatcaagcggctcaccaatacatggtatgctctttgattttggaaggagaaaaatcatatgaaagaaataacagataaaaacttattgtattcaaaaaaaggatttttgataataatatttttgatttgccttattgcaatgcctatttgtgaatattatttcggcttagaattttctactgtattcccaatagtaataacggatacatggtttattacaaaagcaatattttatgatagagaggataaaagaaaaatattatttgatattctcttctctgttgctattacagcaggatgcctttatttcttataagaaacaacattgaactatcgttatagatagttctttttaattttaaaggaggtgatgactataagatgaaaatgaacagtttgatttcatgggtaggtggaaaaaaatctattagagatctgatctatgcaagatttccacaaaactatggaagatatatcgaagtgtttggtggaggagggtgggtactgtttgggaaaaagccagacaagtttgaggtatacaatgacttcaacaataatctatcaaatatgtttgctgttgtaagagatcagccattggcttttattcaggaacttggttatcttcctgaaaacggaagaaatatctttaatctttataaagaaattataaccaagcaaagagtagaagataaatttttacaggaagaaatggaaaaggtaaaggtttattttaccgagcttcagcaagaagaaattatggaaatcatgaagcaagaacggattgagaaacaggatgtaaaacttgctgttgcattttttaagcttgtcagatattcctatggctcagggtgtaaaacttttggatgtcgaccttacgatgtacgtaaagcatttaatacagtctggcaaatcagcgacagattggcaaatacagttatagaaaataaggattttgaggcactgattattcaatatgatcgattagatgcctttttttatttggatcctccctactatgaaacggaaggacattattctgtcgtattcacaaaggaagatcacattcgcttaagagacaccttaaagaaaatacaggggaagttcctgctttcatacaatgactgtgaatttatacgagatctgtacaaggatttttatattgaaggattttcaagaatcaataatatggctcttcgttatgacaaggattcacagtttccagaagtgttgatttccaattacaatcctatgaagaattcaggaatacagaaacagcttgatttatttgagcaggatggaggtgatgaaaatgatgaatgagtatcagatgaaacttgaggaagggaataaagtgacccttcctgaaagtttagttaacaagttgctgttaagaaaaggtgaaacagtctgtttgattcaggaagatggtatcaaggacaagtgctttaaagtaactgcagaaaatgaaaaagaactgttcgatgaagatttttactgcattcccaaaagggtatttgatatgtgtcatttggattatgaaagtattcaaatcatcgttgaacagggacaaatggtcattaccaatccacagtatgtgttgagctatttaggaaaagatatgattacctgtcttttaaagcaaaatgtggatttaggattatttgcaaaggatcttgtagatttattaaatgaacagacaatcgaagaagctgtttagaaaaggaggaaacaatggtacaaattttaaagaataaaaaagtaaaggttattatctgtttgatgatcatcttaataatgcttgtattaacaatgaaacagtcttatgcggcaggagatgtttcaagtgttatccagcaggcttggaaacaaatggagtcgcagattaaaaacattgtcaacaatgttgtgtttcctgttattgatatcatacttgctgtctttttctttgctaaacttgcaatggcatattttgattacagaaaacaaggacagtttgattggacaacaccagcaatactgtttgcgtgtttaacgttttctttgattgcaccaaactatatctggaaagtcctatagaggaatagattatgtttttatgggattttgtcgcagataaggtcatgggacagattgttgactggatctacagtaagctacttgaatttttaggtgaattctttggcatgatgggatcaatgggagcagatctgtttgactatgattttgtaagagccattattgaactgtttagactttttggatgggcgctgtttgtttcaggaatggtcgttgcagtatttgagattgccgttgaatatcaaagtggtcgaggcagtatcaaagatgcctgtcttaatgctatgaaagggtttatggctgtgtctttgtttactgtattgcctgtagaattatataagttctgtatttctttgcaggtaaccatgtccaatggacttgctaaacttgtaggaagtcagtccgtaggtgattcagcaattaagtcactgtcgtatatgcaaaagctgtcgcttggaacggtattgcttatctttttgctgattatgatgggctattccattatcaaagtgttcttcgcaaatctaaaaagaggaggtatccttctagtaatgattgcagtaggatcgctttatatgttttcaattgtgcgtggctatacagatggctttattcaatggtgcaagcagatcatcggtatatgtcttaccgcatttttacaggcagttattttaattgcaggtctgggtgttatgaaagaaaactgtcttttaggaataggattgatactggcagcaagtgaaattccacgaattgcaggacagtttgggcttgatacaagcatgaaagcaaatatcatgtctactgtttatgcggctcagtcagctatgaatattacaaaaacaattatgaacagaagctaataatcatcttgcatttttcctgcttatttggtatttctgttgtaggaggtacagcatgactatcgaagaactgaaaaaatataaatggtttgttgcaacatgcaagtatgaaggtatcgttgggaaaaagcattgttttacatatgatgttgataatttaaatacaaatttgttaagtggaatgattttagttgatgatgaacttgtaaaagaaacagaagaaaagggtgtctggcaggactgtgtttttgatgcgatttgtgatgaaaaagttcaaatcgtacagcaatgttcaaagccaatcattctttatgaagaagttccagaatatgatgagtgggtgaatctgttattgtatcgctatcttgaacagcattattatgaaaagaaatggatgacctatatacaggtcgatagaaaaatgaatgatgaaatgaggttgagctaaaatgtatatgtatcccgataatttaaaagggaaggcaacattatggctatggtatttaagagatattggaatcgtaggtgtgggggcaatcattggagtgattgccatttctcatgccaatttttatatgccaatggcattagtagggtgctatgcttttttaactatccgtatggctgataccagtatctttgattttttatcatatgcctttgccttctttatattttcacaacagctatataaatggcattttacaggtgaaataaaaacacccttgaatacagaaaacaggaaaaagaaatggaggctatgatgaaaagaaagaagaaaacagagaagaaagataccgtgaaaaagaaaacaaagaaaaataaaaaagtatccagtacaaggatgctaatcaatactaagacgattaccgattacagtttaaaactgtttaatggagaggaagtcgtcttttttgttgttcagccacaaaatctttctgttatgtcaaaagaaaacataggtgcaaaaatatttgcacttacaaatgttgtaaaaggactaaatgatattgaaattatctgtctgaacagtcgagataattttgaagaaaacaaatattttctgaaaaaaagaattcaggaagaaacagaagaagttgttatcaagcttcttaaagaagatctgtatcatttggataagattcaaacacagacagcaacagcacgacttttcctgatcgctgttcgtataaaacctgatgatcagttagaagtacattctttgatccatcgtattgaaaaactcattcgtatgcaaaatatctctgtaacacgagcagataaggaaatgattaaaagaatgttggctgtctattttgaacagaatgttacgacaagtcagtttgaagattatgatggaaagaggtggtatgatggtgttcaataaattatttggtaaattcaaaaaggctgaagttgaagatgaagaagaaatcaaggtgcaggattatcttgatatgattgcaccttcaacaatacgtttctatacagaatattttatttgtggcaacagctacagaagtgtctgggcattacgagagtatccaacctctacagatgaacaggcacttttacgttatatgggtgaaaaagacggaatcaccttgcatatttatgccagacaggtcacttctgcagaagaaaagaagatcattgggaatgcagctaataaaaacaggctcagacaaagcaatacgcaagatctaaaagaaacagtaactgctcaaagcaatcttaatgatgttattgaactgattgccaatatgcatcgaaacagagaaccacttgttcactgtgctgtttattttgagttgattgctgacagctatgatgaacttaaacttattcagactgaaatgatgacagaacttgtgcgaagcaagttgaatgttgatcgtcttcttttaagacagaaagaaggatttctagcggttactccatcgggatatgatggattcaaggagcagtttgaacgtgttcttccagcatcaagtgttgcaaatctttttccatttaactattcaggtaagacagatccgcatggaatctatataggtcacgataaatttggaagcaatattattgttgatttcaatgaaagaagtgacgacagaacaaatgcaaatgctcttattcttggaaattcaggacagggaaaatcatatcttttaaaacttttactgttgaatttaagagaacagggaatgtctttaataacgctagatcctgaacatgaatatgaagaagtaacctataatcttggcggtatttttattgatatgatggcaggacgatatatcattaatgttcttgaaccaaaacaatggtcagaagatatagaagattcaggcgaagatgatgttcctgttgcatttaaacaatcaacggttcttgcacagcatatttcctttttaaaggattttttcaagacatataaggcgtttacagaagagcaaatcgatacgttagaaattatgttggtaaaggtctatcaaagattcaacattaatgaaaagacggatcttagtgttctagaacatgacgactaccctatattgagtgatctctatgattacattgatgaagaatacaaacattacaacacaaacagaaataacatttatacaagagaatcactgcgtgaaatattgcttttattaaattcaatatgtgtgggaagtgacagtcgtttctttaatgggcataccaatattcattcacaaaaggttgtgacttttggtgttaaggatcttttacaggcaaataagtctttaaaagatgcgatgctttttaatatcctttcctatatgtccaatgagctgttgaaaagagggtatacagtagcttcaatcgatgaactttatctttttttaacaaatacaacagcagtagaatacattagaaattttatgaagcgtgttcgaaaaaaggaaagttctgttattttagcttctcaaaatctggaagatttcaatattgaaggaatcagagaactaacaaaaccattgttttcaataccaacacatacgttcctgttcaatgcaggaaatacggatgcaagattttatattgatacgttacagcttgaagaaagtgaatatgaacttattaaatatccacaaagaggtgcctgtctttataaatgtggaagtgaaagatacaaccttattgttcatgcaccagattataaatcaaaactgtttggtgataaaggcggaagataggatgatgaatatccatgaaaagtcagcgttttggaatagaaatagaaatgacaggtttaacaagaagaagcgctgctttgattattgctaaacattttgatacaggttttaggcatgaacgtggtgtatatgatacctattctgtctgtgatcaagacggaagaaaatggaaaattgtacgagatgccagtattacaccgcaatgtggaaatcgatttgattatgatcctgattataaagtcgaggttgtttcgcctatctgtcattatgaagatattgaaacgatacagagcattgttcgtgaattaagaaggaatggtcatgctaaagtcaatgaaagctgtggaattcacattcatgtggatgcttcaaaacacactgccagatcattaagaaatattgcaaatattatgtattcaaaagaggatcttatctttaaagctttaaaggtaagaccgcaaagagaagtacgattctgtaagaaaatagatgatgattttttagaaatgctcaatcgaaaaaagccaaaggatattgaggaagttgaaaatctctggtatgacggaaataccagcagaaaatacgaacactatgatgattcgaggtatcatgccttaaattttcatagtgttttttcaaagggaacaatagaatttcggatgtttaatggaacacttcatgcaggtgaaatcaagacctatatccagttttgtttggcaatatctcatcaggcattggttcaaaataaggcaagcagagttaagacacattcgtctaatgagaaatatacgttcaggacttggcttttacgacttggacttattggcgatgaatttaaaacagcacgacatcatcttttaaaaaatctagatggatgtattgcatggaaagatccacaacaggcagttatgcaaagagaaagattgcaaagtgcacaggaaacaaataatgaatcattggaagatgttcaagaagaacttggaatgcacatgcaacagatgtaaaggaggaacagaaaagaatgaaatattatgtggcttatggcagtaatttaaacagggagcagatggcacacagatgtccagaggctaaactggttggaacaggtatgttgtcaaattatgaaatggtgtttagaggaaataaaagtaatgcagttgcgactgtagaaccaaaaaagggaatggaagtacctgtaggtatttgggaaatttcagaaaacgatgagcatttccttgatcgctatgaaggttatccacacctctacgaaaagaaaaatttgagaatttctaatggaacaattacaactgaggcgatggtttatgtgatgaatgatggttatgaatatggagtaccaggtaaggaatactatgaaataatcaagcaaggatataaggactgttctcttgatgaaaagtatttagatgaggctgttgaaaaaatgaaagaaactgttttaaatcaaacagaagcagcaatgtatccttatggttatagagatgtcagacagtaatgaaaacaaaacttataaagttagctctgtccttttttagcagtgatgatggcaggaagtttgtcagaaatgtagctgttgttattatttcaccttttgttgctattactgttttaattggtgctattttttcagatggtatttcattcaatcacaatcttgtaacggatctgtttgaaggcaatccaattagtgaacttacaggtgaaatgaagcaatatgttcaggaaatacaggatggacttgtgttgattgacagtcatattgacaaaattaatcagacttttacaaatggatcatcgcttaatatttatcaggtcaaagggtattttattggttatatggtttcttcacagcataaagtattttcagatgaaatggcagaggcatgggtcaacagttttacagagggtgaagaagtcaaagtccctacttctgtaaacgccgtcatctatgccagtctagaaaagaacctgaatgaaaaactgctgaaagatacaaaaaagtcaatggaaacctgttatggtgcattgattggaaatgacggaaaaacagtcacaacactttccaaagagcagatggatgaactgattaaaaatatgcctgaagatacaagtgaaatcagaaagaaaatagtgatgcaggctgcggatgctgttggaaagataccttattactggggtggttctgccaagtgtgcaggatatgatggtaatgattttggagtaactgttgctccagacagcaaaggaagaaataaaaaaggactggactgttcacattttgtagactgggtctattggactgttatgaacaataatcttggcaatacaaatacatcaggacagataaaaatgtgcaaaaaaatagcaaagcaagatctcaaagcgggtgatcttgcctttttaattaacaaatcaggaaagacaactcatgtaggaatctatgcaggaaagaatgcaaaaggtgaggctgtgtggatacatgaaaacagtaacgacagcaatgttgccatgaatactgtgtcttactggagtggttattacagactgaatatgatggaaggaagatagcaatgaatgaacaaaatgaatttataaagaactacttgcatacagaatatgttggctgtttaaaaacggatcatgaaaaatgtatagatcttcagtatgaagaaattggaaactttgtacagaatgcagggatgtttggtgatcttgaaatctctataaagcacaatggcttggtactgtttgatacaaatggtatttatatcaacaaggtgtttcctaatacagaatattccagagattatcttatggaacttatcaattctgttgcgatgcaacttcaaagtgatttcgatgatggagatataggacatccaataggcaaagtcaatgagtttattaaagagaactttcaagttgatctgttgaatcttgaacaggaaaataaagtaaattttagtttgcaaatgtaaggaggtgaggaaagtgaatcaagataaaattaaggaaatcaaacagaaatatccaaagggaacaaggatcatgctcaattctatggacgatcctcaccatcctgtaccctctggaacattaggaactgtagaaacagttgatgatattggaacaatccatatgaagtgggataatggacaaagtttaggtcttatcgtaggtgaagacagcttctatgttattgaaagtgttcaaaatcaagagaaaatacgagaagccgatgaaaaaatacgtgtactcgttgttgagccgatgaaagaaccaaaggttgaatatatagaaaatacattggatgatatgcaaaaagttgttggtggtctgattgaagaaatcgacttggataataatactgttcttgtctgtaacgaggaaggaaaactcatgaatttacaggcaaacagacgtgttggcagagatgttattgctggcactttttttattgcaggagatgatggatcagaagatctagtttctttaaccgatgaacaggtcaatgaatataaagaaagatttcatgaattagaagaaatcgagcagcaagaagtgtttgaaaaaattgaaataacgataagggggttttaaaaatggttaaacaaaaagagataaaaataaaatatcctgaagcaagagttagagcaatcaactcaaatcttgcaaagaaaaatacaacaattgaagtagaaattatggaaagcttgaatcaaatctataaaaagcacgtcaaaccagaggtcagagaattcattgaagaattagaaggagatgaaccggtcgttagtaaaaagcccagaacaatcattgaggaacatccataaatcaatgtatcaaggagtgtttggcggtaaattttgatcgtgtgcgctttttatagaaatatggaataagtatgccaattttatttgtttaaaaacgtgtgcccttattttaaaggttttaaaaaatagatggatagaatgtccaatttgaattgaaaaataagggtaacttttaaaagatgtggcgtgtgcaggttaaagaagcgacgtcgcttcaccttacaacaacgggcaatgcccgttgtttcaaagaggttcacaaaagaaagacaacgtcattattgaaaacagtgcgtcaatagtggcgttgtataataaatattctcctggaaacatcaggagataacaggtcgtcaaaaacagcgtaagcagaattttgacgaaaactgtagtttgaaaatatgtgatatgttataatcataaatggaacagccgtatacggtaggtggttatccttggtcgtcatgacgaaggtacgcaatccttcgaaattcatattcctagaagttttgggaaaatctgaaaaacggaggtgatgcgaatgacaacatatgaaacagtcatggtagtgttaacttgtttaacacttgtcgtgtctttaatgatgcttgttattaaattacttcttatcataattgataaaagtgaaaaaaaataactacctcagcctctggaaaagtatgagttagttattttaacaaaaatacaaaatccaaggatagccgcttactggcagttccttttttcaactacattatagtttatacaaaactgaaagtcaatataccagtgtattgagaataactacctattaactacctatgcactacctacgacacaaatggggtcatttttgattgcttgaaaattcaagaatatttgatgaaaaaatgaatgtaaaattataaacagaataataaaattgataaatttaaaattatatataatagagaaaaacggatacaaaggtatcctttttttattggaggaaaataaaatgtgaataagaaaagaacaacgatttggctaagtcaagatgtgatggacagactggatgaaatgacaaaaacagatgacagcaaaagtcgaagtgagtttattgaaagagcaattaaattttatgatggttacaatcgctcaacgttggaaaatcagtatttgcctgttgctatttcaagtgctgttcaaggaactgttaagtcaagtgaagatcgtatttcaaaattgctttataaaaatacagtggagctttcaatggtcatgaatgttctttcagcaatagctgatgttgataatgacactcttaaaaaattaagagtgaagtgtatgaacgaagttaaagcaaccaatggcaagataagttttgaagaaataaataaatatcaaaaaggttcctgattcataatagctatataaaaacagttgtgatagtatgtcgtctagaaaggaatgatctacatgtcaaaacaggatgaatttataaaacaactttattatggagatgatttattctatgaaaatactagaaaagattcttcaaaaaaatgtgagttaaataaaatcagagatgaaattcataaaaaaattatgaaggcattgatacaggtatatggtgaggaagaagcaaataaaataaatgaagaatggataggatgttcatcagaaatagaaattgaaaatgaaatagttatttttaaagaggcattgtatttaggatatgatcttgcagatgtattttttaatagaagataggaagtatatgttaggaaactttaaaaaggttagaaaagaattatggaaaagaaggagcaagtattattgtggataactgtcaggatacactatttggcggttttgcacctaattcagaaacagcgaaagtaatgagtgaaaatctcgggtcaaagactgttatgagtggatcggtcagtaaagggaaaaatgatccatcacagtctttacaaatgatagaaagacctcttatgacaacagatgaattaaagtgcatgcccaaaggccattttattttgatgaagacaggaatgcatccaatgaaaacagtattaagattattcattaagtggaagataaagttggacaaggaatatcaagtcaatcaaagagtacagagagaagttaaatatgcagatataaataagatcacatcaattttaaaatataaatttaaaaaagatgacaatataaaatttgatcttaaaaaaataataaatgaggcaggtgttaaagttgaataaggattatatgtatttttatacaaaagtatcaagtgcaaatgtaacaccgtcaggaagaatggtatatagagcattactacgatacgcaaacaggaaaacatggtcttgttttccatcagttaaaacaattgtcaatgatacaggactttcagaaagaacagtaagaaaacaaataaagatacttgtagaagaagaactcataataaaaattccaagaaaaagagaaaaccatggaaatacatctaacatgtatttttttaattgatctttatcttggaataattgtaattatataagtgcataagggtggtgcagttaagacatccctgtaatttgttttctaaggatttttcataaaataaaaatatttattgaaaatgtttatcataatttgtaaagcaaaataaatatgagtttaattaagaaattatagattaaaagatgataaatattaatgctatctaggaaagaatatcattttatttatcatctttaagaaaacaattaataatatttttcatatttatacctcatttctttttttatatagatatctataaaattattatacttaaaaatgagtaattttatagataggatagttaagaagtaggttatacgaatgcatacataattgtaaggaaaaaaagattattttgagcatgaaagtggaaaaaattacctgttaatcataaattgagcatcttaaacaaaatgtatttacattctatatagcgctttcatataatggacttgtaagaagtctagactttataatttaatacgaaagaaggtagatattatgaataaaaaaataatacaatgcaggaaacaagtaaaattgattaatttctatgacaaaaaaataataaatgcaaagtatagtacaaaatataataatttaaatagtatatttttttaatagaaaacataatattgaattttcgatgattattttaaaaactaattattaaaaagtagagaagctatgaaagagtttaaatataatattaaaattctattaagaaagaaagagctatattattgtattattggtgttttgttaatcaatgcgattcatgtaattttggtaattaatcactattcaccaaatatgattttgaaaacaggtgaatatcagtttattttatataataaagaggtaactataatgtcattggtaataatagcgttaccgattctaacttctcttgttttatcagatacgagttggaatgataaacatttagggtacaataattatttatatacacgtttgaatattaaaaaaaatattttttctagattatttctatcttttattacaacttttataatttgttttgtaggtttcatattaaattatttaacactacgtttcatttttggtagtggaaatcttataacaaattttcaagaattaccatatgatcaagtaatagtatctgagttttttctagattctatcagatattataatcctatactatttattattttaattagtttgcatgagtcagtaattataggattactttcaacaatttcttattctttttcattttttacaaggcaaaaattaattatttattttcaagttactcttattatgattatactcgaggttgttttttcttttattggtatcagccagttttcaatcataaagcagttacagccaaattcatcgttctcggtttatcaaagtattattttatatattgtactttctttaatagctattacaccagttttgttaattacaaagaaaggtgatatattatgaaaagatttttttgtaattcattgttctatattgggatagttattatgattcttttgggtatagctgttggatataatatagatcataattttttaaagttatatactgcaaaaatgggacaagttcctataagatactgcatttttattattattctttttatagattatcttttatttgaagaaataaatcattacacttttatatttagatataaatcggtgtcaaattttataataaaaagtatgaaacaagaagtaattatgtcagtaattttactattaatttttcatctgcccatattcatattaaatacaaaggaatttattaacaatattgttttgattatgctagtaattttgaatataactttaattttttcagttatgctggctattattagattacttaatgtatggattaataacagaattacttctactagtatttttttattagtatttgcttgtttggatgttttattaggacacaaaaaaaagaaggaactggcaacgagctattttcgcacaatgtactatcttcgccgcgatgatgcttaacttctgtgttcggaatgggtacaggtgtgtccatcatgctatcattaccagattcttcttttcaagtgtcttcaggacactcaaaaccagacagtagtttttcttctttcaagctcgcttgccttttcggtcaagccctcgacctattagtatcagtccgcttaacatgtcaccatgcttacactcctgacctatctaccttatcgtctttaaggggtcttacttgcttgcgcaatgggaaatctcatcttgaagtgggtttcacacttagatgccttcagcgtttatcccttccgcatttagctacccagctatgccactggcgtgacaactggtccaccattgatgcgtccatcccggtcctctcgtactgaggacagctcttctcaaatttcctgcgcccacgacagatagggaccgaactgtctcacgacgttctgaacccagctcgcgtaccgctttaatgggcgaacagcccaacccttggaaccgacttcagctccaggatgcgatgagccgacatcgaggtgccaaacctccccgtcgatgtgaactcttgggggagatcagcctgttatccccagggtagcttttatccgttgagcgacggcctttccattcagcaccgccggatcactaagcccgactttcgtccctgctcgacttgtgggtctcgcagtcaaacacccttttgcctttgcactctgcgcttggtttccatccaagctgagggtatctttgggcgcctccgttactctttgggaggcgaccgccccagtcaaactgcccgactgacactgtcccgtcaacggctctacgtcgtccggttagaaatccaatacaacaggggtagtatcccaacagcggctccttgaatactggcgtatccatctctttgcctcctacctatcctgtacatgctgcatcaaatcccaatatcaacctgcagtgaagctccatggggtctttccgtctagtcgcgggtaacctgcatcttcacaggtactaagacttcaccgagtctacagctgagacagcgcccaaatcgttacgcctttcgtgcgggtcagaacttacctgacaaggaatttcgctaccttaggaccgttatagttacggccgccgtttactggggcttcagttcagggcttcacttgcgttaacccctccccttaaccttccagcaccgggcaggcgtcaccccctatacttcgccttgcggcttagcagagagctgtgtttttggtaaacagtcgcttgggccgtttcactgcggctcatatctctatgagcactccttctccctaagttacggagtcattttgcagagttccttagctatagttctctcgctcaccttaggattctctcctcacccatgtgtgtccattttcggtacgggccatatatacttaacgttagaaacttttcttggaagttcctccactgccttccgtactcgccgtagctttccgtacgcttcacgccttctcgtttcggatggtggatttgcctgccatcccgatatctcgcttgcaccagctcttccagccgctggctgcagcttcctctctccgtcattccttcacatatatacgggtacaggaatctctacctgttgtccatcgactacgcctttcggcctcgccttaggtcccgacttacccagagcggacgaaccttcctctggaaaccttgggttttcggtgcgtgggattctcacccacgttccgctactcacaccggcattctctcttccatgatctccacacgtcctttcggtcgtacttctccgttcatggaacgctcccctaccatcccttgggatccatagcttcggtagtatgcttagccccggtaaattatcggcgcagagtcattcgactagtgagctgttacgcactctttaaaggatggctgcttctgagccaacctcctagttgtctgtacatctccacatccttttccacttagcatacattttgggaccttagctgatggtctgggctgtttccctcttgacaacggaccttatcacccgctgtctgactgccgagcatgttggcgtgacattcgcagtttgattatgctcagtaccccgagatggggccatcacatattcagtgctctaccttcacgcaactcttctctcgacgctagccctaaagctatttcggggagaaccagctatctccgggttcgattggaatttcacccctagccacaactcatccgccaacgtttcaacgggggtcggttcggtcctccatcgggttttaccccaacttcaacctggtcatggctagatcacccggtttcgggtctactgcatgcaactcgcgccctcttaagactcgctttcgcttcggctccgcatatcctgcttaacctcgctccatacagtaactcgccggttcattctacaaaaggcacgccatcaccctttaacgggctctgacttcttgtaggcatatggtttcaggttctctttcactcccctcccggggttcttttcacctttccctcacggtactggttcactatcggtcactctctcgtatttagccttgccggatggtcccggctgattcagacaggatttctcgtgtcccgccctactcaggtgtcatctctctccagtctctcatttcgagtacggggctctcaccctctctcgctcaccttcccatgtgattcctctatgatcctctgtttgatttatcgatgatcctactaccccgatcctcaaatcggtttgggctctttccctttcgctcgccgctactcagaaaatcattcttattttctcttcctgcaggtacttagatgtttcagttccctgcgtctcgcctcatcatgtctatgtattcgacacgtgatacacggatatgactccgtgtgggttcccccattcggatatcgacggctcttcacgtgcttaccgctcaccgtcgcatttcgctgtttgctgcgtccttcttcgccggagtgtgcctaggcattccccatacgccctttcttgctttaccttctaggtttgcttgcttgaactttttttcgtttacacttgctgtaaaatcttagttactttcgacttttcgtactagaccttattttttctttaatgtctaatctcttctttatcgttttcgcaatttttttactactatccagttttcaatgtcctcttgaatgtcatggacattcaaaaccaaacaagaaagcacaactttctctccctagaaaggaggtgatccatccccacgttcccgtagggataccttgttacgacttcaccccaatcatcagtcccaccttagacagctccttccttgcggttaggccaccggcttcgggtgttaccgactctcatggtgtgacgggcggtgtgtacaaggcccgagaacgtattcaccgcgacatgctgattcgcgattactagcgattccatcttcgtgcagtcgagttgcagactgcagtccgaactgagaacagttttatgggtttcgctccacctcgcggcttcgcttccctctgctctgtccattgtagcacgtgtgtagcccaggtcataaggggcatgatgatttgacgtcatccccgccttcctccggcttgtcaccggcagtctcgccagagtccccaacttaatgctggcaactggcaacaggggttgcgctcgttgcgggacttaacccaacatctcacgacacgagctgacgacaaccatgcaccacctgtcttctctatagctatctctccatctctggagcctttagatcgatgtcaagacctggtaaggttcttcgcgttgcttcgaattaaaccacatgctccaccgcttgtgcgggcccccgtcaattcctttgagtttcattcttgcgaacgtactactcaggcggagtacttattgcgttaactgcagcactgagatttgactcccaacacttagtactcatcgtttacggcgtggactactagggtatctaatcctatttgctccccacgctttcgggactgagcgtcagttatgcgccagatcgtcgccttcgccactggtgttcctccatatatctacgcatttcaccgctacacatggaattccacgatcctctcacacactctagctctacggtttccatggcttaccgaagttaagcttcgatctttcaccacagacccttagtgccgcctgctccctctttacgcccaataattccggataacgctcgccacctacgtattaccgcggctgctggcacgtagttagccgtggctttcttatagagtaccgtcacttggatatcattccctatatccaccgttcttcctctatgacagaagtttacataacgaattacttcttccttcacgcggcgttgctcggtcagggtttcccccattgccgaaaattccctactgctgcctcccgtaggagtctgggccgtgtctcagtcccagtgtggccggtcaccctctcaggtcggctacgcatcgtcgccttggtaggccgttaccctaccaaccagctaatgcgccataagtccatcatctaccagtcccgtagcacttttcatatagagttcatgcgatctctacacctatgcggtcttagctgacgtttccatcagttatccccctgtagatgccaggttacttatgtattactcacccgttcgccactcttcaccgaagtgaagcgttcgacttgcatgtattaggcacgccgccagcgttcatcctgagccaggatcaaactctccattgtcttatttctttcagacaactttggtctgtttagctcttttttatttctttaacttaattgacgttgtgttttattctttcctgttcagttttcaattgaataatcttacaaaaatgtaagagagagttatatataattaaattttgtaatttatctcaaaataaaaaaagctagattttacaagggttttaaaaaagatactatcatttcaatttaatataacagtatctagctttaccccaaatttaccccaaaaataaataagtgttataccaggatctatagctattagtcattttaggctaatagtttttttagctacgtactcaatttggatacatagctattatgatcttttataagagtgttcatcatttagtgtagaccttacaaaagaggtagcgcaatcttgcccacccctaaatataaaattttaatatgttgtaagctttactattactcatttttaagtaatagctttatttgacggctgaattttcagctaccacataaatatatgattatgttatcttatttttttaacacgctcattttttagctagttaatgttataggactttcgcccaattttgggcatgttgatattttagggtgttgctcatttttgagccgtagctattatgatctaatttattagttatgtttggttgctcaattttaggccactaatattaaacaaatagttttagacttttcggtccataactctatatagcattttctaatattttagaaatgggggtaacactttagatttcctattacaaatataaaataatgtgcaaccattttaagagtgcaaccaacaaaaaagggtgcacacttttgattttttaatgatcataatactatgatattaataaaactgataaattatattagttatgcttatatctatttcttttagggtgtaaaatagttttcaacctaaaagaaaaaccgactattttttgtcggctttttttggcttgtaatatttagaccaagtaggaatgtttcctggtcctccatctaaatattcatcttcctcaagctgttttaattcttcttcagtcaataaatcttcgagattaccttcaatttcaatttctataacttgcgctttttcatcacttttcttttttgatttcataagtatccttctattgtccttgttcccaagcccatttttttgctttctcatatgcatcaattgcttctttaggcacattttctaaattgccttttgcaatttgttcgtagtaagggttaaaaatatcaaataatttatcaatttcctctgggaactctctataaaccatgttattatcaatcctttcttttcttccatgcacaatattcagcttcaacttcatcatatctatgcaatctatacattttttttgcatatttacttatctcacctacattatattcttttattggtggggcatcaatctattatatcgtgttttacctatgtacttttttatacaagggcgtaccgaaaatgtcacacccttttgaatgtctatataataaagagggtgcacgaaacagtcaccctccatatttgaaataaccttaacctttattaacaaaccgttttatcatgtacaagtatttcatttgcttttagtttttttagaataatatcaaagtttgttgctacttcattttttaattcatcaataagatcttgatttacctgtaaaacttgagcaagttcaatcatcccatcaatttcgttcaattctgtaattgcaaaatctaaatccgctatattggttaaatcttctaagctttttctttgttccataattctgtttttaattgtgttatatgctttatttttcattattcttctttcctttcactctctaaatccttttattttgagttataagcgttgttttataaaataggtattctttttcaaatgatataatatcgcttaatgtggcttaaatttgttatgttcttatttgctataggcacaacctttcttttgtgctttaacaccttgaacatatcccaaggtaaaagcatctataaccgcttctacttggccattgctattatttaaaatattagtaatatcactcgctctcatgttgtagagaggatttatttctttttgtgcatttttaattgtgtgttctatatctactattcttgacattgttcttactccttttctcttttaatgtctttataaaattcattttctaacttttctagtgatggcttgttgtttaaatcaatgtatttggccaattctaaacatgctttagggaaagctcttttatatgttgattcacttatataataagatttatcaagagttctaatcatttcagtataccctcttgaacatacatacgttctaatgatgtttctatgtcgtgtattaagtaaataaattaatggcataaatttatcaagttctctattaaagagctctaggcgctttgttagaagctctctacgtaacatattagaagttatttgttctccttttgattttgagaagcctccaggagcttcatttgaatatttaattgattgagggcttggaatgtcctcaatttcaaatgttaaagaaagtctttctaaatttatttttcttaattccattagatattctttgacttgcttaactgtttctttttctttttcattcattatccttttctctcaaaatactagctatatttagtaatgatttttgaataaatataaattcatcataagaatatattgatctttcaatacctaaaacgaatgtatttaatagctcttgtgaagaaataataacaatgatatttaattctttctcatgaatgtattttgaatgcattctagcgctattaagtatttttaaaaaacgtttgtcaatatcctcgtcaaatacttctctttttattttttctaaacaatttaacataattaaagtgataataagaataaaaaatattataaaaataattaattcctggataggagggtttataaaaattctaataatgccataaaacataaataataaaccaaaaataaataagcatttttcaaacttatcacttcttattgcttttctaattttaaataacatttcaaactccttttatatgtaacaatttacaattttctaaatagaatgtgatcatattctttacttaatgaaaatatcatacttatatattttataaaggcgcttttatcgtcactttcaaaagttgctttatatagtaatttatcttttttattaaatacgagtacctcacctttagatttaaaatctttttttatttttctcattataaagttcttttcatgttgttgattatatttgattaagatttataaacaaataacattgttgatgtagaagagggagagcttataaaagttttaattttagagatcatatcttttgaattgacccaatgaaatatttttataatatcttcttttcttcctaaatttaaacctaatgatatgttgttttgagtatgattaattaacaaaaatgattttgtactttttcctcttttaattatgtatgttttatttgctttctctttgtaaatcatttatttatattctcactttcttttgtattttaatgttatataacatatagacactatatatattcatgattgtatttttaatactaataacggtatcgtgtgggtgggcacaacaccccctctcctcaacttacctcacctaatctatactaatctaatctatactaatctaatctatactaatctaatctatactaatctatgcggacatttgacaaccatttgacaaccatttgacaaccatttgacaaccatttgacaacgataaggaggtagaaaagatgtgtaacttaggagaaatgattgaaagagaagcaaaacaagcaaagaatatagaacatttacaaaatgtaatgcatgagcttcaatgttcattagaaaaggcaatggatattttaaaattaacagatgatgaaagagaagaaattaaaaaatattttcaagcttaacataaaaggatagcagtttagctatcctttttataaaagactacatttttttatttgtgtttttaataatataaataggtcgttgtttagattcaaaataacaagaggaacaatattggcctaaaatagctacaaatacaagttggataccacttaaaaataaaactaaacttgttaagtaggatagatgatgaataaaaatagagtataaagatataaaacatgctattgatatcaatattccgccaataactccagccattgtaatgggtgtagaagaaaaagaaaagatacctttaaatgcataagaaaataaacttttaaaactccattttgtcttacctgcaggacgttctacattatgaaattctaaccatttagtattaaaaccaacaaaagaaaacatgcctttcatataacgattatattcttttaattctaaaatcgcatctaccatttgtcttgtcatcattctaaaatcacctgctccatcatccatatccattttcgtaagatattgaatcactttataaaaactatgtgataaaaaatttcttaatttattttcaccaatacgatcaattcttttgccggcacaacaatcatagtcttcatattttaatgcttgatacatagattctaataaataaggtggatgttgtaaatctgcatccataatgactacataatcaccactagcgttttctaaaccagcatacatagctgcttcttttccaaaattacgtgaaaatgaataatagaaacaatgtttatttttatgtgctaatagtttgagtatatcttcactatgatcttgactaccatcattaataaaaagaatttcataatcaatgttttgaattttctctaaagtatgtacaacttctttatagaaaaggggtaaaacttcttcttcgttaaaacatggaacaatgacacttattttatccattataaacaccttcttttttaaaaattttaaacttacataaaacataatttgataaaatagttacaaaacttactaataacttagaaaacatgggttgtatatgcattaaagtaataaaaatatataaacaaccattttcaacaattaaagttaaaaatcttaacaaaacaaaagaactcaattcttttttgatatcattttgactttcaaatacatattttttattagcataataagcaaatataacagcaaaaaaccaggagatactattagcgattaaccaatgacaatggatcatcaataaaacaaaataaacaatataattaacaagtgtagtcataatacctacaaaaacataactaataatctctttagtattttctttcatcttttattttcctttcaattaaataatgtataaaaacaaccataaatccaaaataagataaaataaaacctaatctataaccataaggagtaaacttaatttgaatttgatgttttccttttttgattttacatcctaaaaaagcttcgttaacaacttcacttttaacttcttgatgatcaactaaaatttgatatccacgatcataaggaatacgtgtaataaaataaccatcattacttacatttattgttccatttaaaatatcttttcctttatttatagatagaggatcaacttttatatttttaagagcatttttatttaaagaataagtttgaatattctttaagtcatagtgtcctttagataatgaaatagataattgttgagctgttaataaataagtaaaatgtgtattttgattataataaggtgaagtactttttgataatttattttttataccattaatagtaatagaaacactttgtaaaggtagatgattaataacatctccttcaattacaatgatttcattatttgtttttctatttagttgataattaatatgtgtttttttattatttttaatttgatattctttttttaaacccatatcttctttaataaattgactttgataatcattatttccatcttttacaattgcttgatgatatagtgtatctaaagtataagggtatttcagtttttgaaattggttttgactataaagttgatttgtcgcataagcaataggtttaacatcttgactttgataaagctttaaaccatttatttcatcaactttttgatatccttcaattttctttttagaaacaatagaatcaacagacatcagttttaaataaaagagatgattttgatctatttgggcaacacgattattaattgaaataggcaatttcaatgtatcatataaatatgaattatataatttatgatttgttgatgtataaccagaaatacgtgttatttgattttgatatgtttgattcatattttgtttgctttgatttaaattaactaaagtattgattttatttctttgaatgagtgtttctacttcttcatttgaatagttttgatattgttttgttgatataaaacttgttgttggattattaaaataaacaacaagtaaaggaatcaataaatagataaaaactatttgttgatggtgtttataaaaataaagaatggttaagctgacgattaaatcaatacatacaagataaggttgagtgataaaaaataatggtaaaataattaaaataagcatagaataattgattctaaaagtgaaatcttctaaaactaaacctgcttgtaaaataatgagaggtataaatacaatgagtattttacttctagcatataaaaaaccattcattataaaactaattaaaggacaaaacatagaaattataataattaatgatagtaaacgcgttttctttttatatagaccacatacaattaaaatccaaataagatatgtaaatccacaaccataattgttataaagtaaaccttttaaagaaaaggtaggcattaataaatctaatagatgtgttgaacttacacttttactaccaccagcaataacatataaagtaggaattgtataaatagcagttagtaatacaatacctacataagctattaataaatgaaataaaggtttcttatattctttatgattggcacattgcataacgaaataaataaaacaaacaataaaacaagcaatacaataaaaataactatgtaaaacaatacaacttccccaaataataatgcctgtaaaatgatgattaataaaataatgatcaatacttcttaacatcaaaaataaaaaaggcatataattcgcaaacatgacttgtttgtgaaattgaaaaaagatagaagataataaaacaaataaacttaataaaaaacataaatcatttctttttaaatgtctttttaggaaaaaataacaagttaaatttgttagaattaaaagaaatacttgataaccaataaaaagatcaatcatctttacattgataaatagtgctcctaataaaacatcaaatcttaaagaaccataataagaaaaataataaatattaactcctgacattaaatgagaaagataagtaggaaaaatagttccttcttctcttatcgcatgtcttaatgcatcagcaattgtaatatgttgattaaaccaatcaactttatttccaaataataagttttgacttgtgataataaataaaaataacaagggaatcattattaaaaggaatatatataaataatcttttcttttcatctttttttacctcgaaaagaattgtatcaatgaattcttaataatcgccttaattaattctaaagaaatcctaaacaactttataaattgtggttattctttttagaaagtcttaagaattcttatgaattgttattaagaaagaagtgataaggtataagaggtgatagaaatgaagaaaatattaatttgtatattagttgttttaggatgtttttttatagatcatgaatcttgtagacatcaaaatgaaatagatcaaatcgatttaaatgattgtcaaaagttgatgattgttgctcatcctgatgatgaaacgatatggggtggtaatcatttattaaaaggacactatttagttgtttgtttaacgaatggaaataatccaacgagaagaaaagaatttatgaaaataatgaaagaaacacataatcaaggtttaatctttgattatcctgataagacaaatggtaaaagagattcatgggtgcatgtaaaaggaagtatagaaaaggatgttgcttatttgagtcataaaaagaagtggaaatatgttgtaagtcataatcctttaggagagtatggacatatacatcaccgtttaacttcacagatagtcagtataaagtgttctcaacaaaatttatattattttggtaagtattataaaaaaaatcatgtacctgaaaatttaaagaaaataaatcaatatgatgctaaaatgaaattaatcaataattatacatcacaaaagaaagtaatgaaacatttaaatcatatgatgaaatatgaaaattgggtaaaggctaaggattggagaagtttatgaatgaaaagataatggtagtagatgatcatgatgatattagggaagtcatacacgttttacttacaaacgaaggatatcaaattatagaagctaaaaatggaaaagaggctttagaattattagatgattctattgatttaattattttagatgtgatgatgccagagatgaatggatatcaggtttgtttattaatgagagaaaagacaaatgctcctattttatttttaacggctaaaggtcaagaaagtgataaaacattaggtttttcaagtggtggggatgattatttaactaagcctttttcttataatgaattaaatgtaagggtaaaagctttacttagaagatatcatgtatatcaaggtaaaaaagaggaagcaaaagcaattattagattaaatgatttagaaattgatcaagaacataaagaagtctatttaaataaaaataagttatctttaacagatatagagtatgagatattagattatttagttttaaatcgtaaacaagttatttcagcaagtcagttgtttgaaactatttggcatgaaaactattattatggggctaataatacaattatggtacatatacgtaatttaagaaagaagattgaagaagatcctcaaaatcctcgaattataaaaactgtctggggaaaggggtattatattgattaaaaagaacttgaatttatcaatgaaaattgttttactacttctttcttcagctatgcttgctgttttgtgttatgcagcttttcgagaaaatgtgacagaattttatgattatattgattctatagaaaaaccctttaatgaggataaattttttaaaagatttgaacaagaagcacaagaaatcaatctttattctaaaaataaagaagataaaaaagcattaaaaaaattattaaaaaaacatgatatttataccaatgtttatatttatgatgatgcagaagataattttctaggaggagattttggtaaagtattggatgaacctgtaggaattacaccgttatatagtttacaaaatgattttgaacagtattcttttaatagattgataagtgaatcagtgaaatttaaagatggcgagggaattgtttatgttagttctatgcatttattaaagtatgtaaaatactatttttatgttgctttgtttgttagcttacttattttctttttaccaacttttatttttattaaaagaaaagttaaatatattaatattttaaaacaagaagtattaaatatgtcacaaggggatttgagtcatgctatgacgattatgagccatgatgagttagctattttagctcaagagatggatactttaagaataacattagcttctaattatcaaaatgaagcaaggataaaagaagctcatcaagaaatgattacttgtttatcacatgatttacgaacacctttaaccgctttaagaggctatttagatattttatgtttacattgttataaagatgaaaaacaaatggatcattatttaaatagttgtattgaaaagactgaacaaattaaagatttatctaataagacatttgaatattctttggtttataatgatgatttaattccaagtttagaaacgataagtagtgaatcttttattcaatatattgaagaacatttagagtatttagaattagaagggtttaagattgaaaaagagataacaatttcatcagtacaattacacttagatttatcaatgatgaaaagaatgatggataatatatgttctaatatccaaaaatatgcaagaaaagagcaacctatttatttacaaataagtattgaaaaaggaaatataaaaatagtttttgaaaatgaaaagaaagaaataaatcatgaagttgaaagtaataagattggattaaaaagtgttaaaaagattatagaaatacatcaaggacaatgcttcattcaagatttaatggattcatttattttaattattacatttccatgtcatttataaaaaaagatttcaaatattatgcatataatataagaaatcttttttctttattcttctatttcaggttttatcattttcatttgattcataatttttctaatatgatataagctttcagcaatatttaaaccatgatcaccaattctttcaaaatcagttaaaatcttagtataaataatactattttcagtcgaacatttcttttcttttaaacgaattaattgattaacagtaaattgatgttgtgttttatcaatattatcttccataacatcaactttatcaacgatatttttaaactcatcataatctaaaataatcagttcatctaagatattattacataaactttccataatacttatttcttttaaagcatcagcagaaaaatgcgtatcatcttcagctaatttttgtgctcttgaagcaatattaatagcatgatcaccgattctttctaaatcagatgagagttttaaaaataatacaattgtttgagaaccttctgtaggaaactcatttgaaataacttctgtagtaaaatcaataatttgttgattcaaataattaatatattcttcatcctttaataaacgttcatatttttcttgatcaaaatgatctaataattcaaatgcacgtttaacattatgattagctacatttaacatatgttgagtttcattaaataattgagtattcgcaatagcacttgttccaatatgataatcattgttaaaaatactaaaatctaagtatttaagtgacatatgttgatgatcttctggatcatcaggtaaaatcatcttagcaagatcaactaattttgttccaattggaagtaataataatgttgtagcaacattaaatattgtatgtacattggctatttgagccgcaacattatttggtgttatactttcaaccaaatgagcgaaaggaaataacatactaatacttacaaatataacagttccaataatattaaaagttaaatgaataatagttgttcttttagcatttttacttgttccaatagaagctaaaacggaagtaatacaagttccgatattttgaccaaataaaacataaatagatgatgataaagtcatgaccccacttttagctaaagcttgtaaaataccaacagaagcagaagaactttgaataagcgcagtaaataacgctcctactaaaataccaataaatggattttggaatttagaaattaatcctacaaactctggcatagtacgaagcggaaccatagcgttagacatagtttccattcctataaataaaatacctaaaccaccaatgacacttccaaaagcatctaattttttacttttaaagaaaacaatcattgctacaccaataaaagcaattaaaggtgcaattgctgtaatatcaattgcaatcaattgaccagtaatggttgtaccaatattagctcccataattacccacacagcacttgttaaagacattaacccagaattaacaaaacctacaaccattactgtagttgctgatgaagattgaataatagcagttactaaagcaccaactaaaactcctaaaatacgattcgatgttaatttttcaagaatcgttttcattttatttccagcagccagctctaatccattagacatcatattcattccataaaggaaaagcgctaaaccacctaacatagaaaaaatatttgttagtttcatatataatccctcacaatccgttagtagattaacactttcttaaggtaatgtatataaacttaacatattcttaacaaaaaaagctcctaagagcttttaccaaattcctaatatatgttgcataaataaactcatacaggtaatactgatccaacaaataaatcctaataatataggttttccaccttttttaattaattgaataacatttgtattcaatcctatagccaccattgctaaaacaataaaaaatttacttaattctttaaatggtgtaaagaaatcagcagaaacccccatatgaatagatattgttgtaataagtgaagctaaaacaaaataaataataaagaaaggaaaaactttctttaaattaaccttttgaccatctttattctttcttaacttaaaaaaagataacactaaagtaataggaataatagccaatgtacgtgttaatttaacagtaacagctttatctaaagtagcactttgtaaatgatacatcgaatcccatgtagaagctgcagctgtaactgaagatgtatcattaatagctgttcctgcaaaaataccaaatgcttcgccactctttgtagaaaaaccaagaagtgtaccaagtgttggaaataataaggcagcaatcatattaaataaaaagataacggaaatactttgagccacttcttcatcgctcgcttcaattacgggggctgttgctgcaatggcagaaccaccacaaatcgaagatcctacaccaataagtgtggatatcttacttggtattttcattgctttatgtaatacataagaaacaataagtgatgtagatattgtcacaagaatgattggtaatgattgtttacctgtttgtaaaacaacagataagttcattccaaatcctagtaagataactgcatattgtaaaatcttctttgaggtaaaagtaattcctgattgtaattcatttttatctttaataaataaagtaataatcattccaagaataattccaaagacaggaccacctacaataggaaacttctttcctaaaaaccaacaaggaatcgcaataactaaacataatagaatacctttataattcttctttaaattcataaactctctcctttaaaacaaaagaagtttatcatattttgagtagaattagaattaagaattgttaagaataattttttctcattcctttgtcattcaaagtagattcatgtatcattattagatgagggatgaatatgaatagtgaaatagtaattttaatgccagtttataatcctagggaggaaattataaactatatcaaaaaattgaaaaaagaaagatattctattgttgttgtaaatgatggttctgatgaaaaatatcattctatttttgaaagtcttgttgatgattgtacaattattaactatcctgtttctaaaggaaaaggaaatgctattaaaaagggtttaaattttattaaggaaaataatcaagatagaaaaggtattcttattttagaagaagattatccaatagataaaatgactcaattaaatgaattatttaaacaagaaaaaatcttttttattcatacaaaaggtaaaagaatattttcaaagatattttctatgatttatcatcaagaatttaaaaatgttgatagtagaattattggtttttctatgaaatatttagatcaaatgttgaaagtagatgaaaattgttatgaagtacaagtattgattgattgtgttcaaaaagaaataaaagttaaggaaatagttgttgatcaaaataaagaatgttttcatctaaaaaataataatcgtaacatcctttacgttatcttcttacatctattccgttttatttcatcttcagtaattagttctgtcatagatgtattacttgcttggcttttattagatgtattaaaaatatggatgacaagtgatttttggcgtattgctattgctagtcttgtagcccgtgttatttcaactgttgaaaattacatttacaataaaaagattgtttttaaagaaagaactgaaactaaacaaacagcaattagatttttgattttaacagtagttattacaattttgtctacactttttgtttatgttttttctacgttaggtattatgtctgaaaagcttgctaaacctgtaggtgatttattattatttttattaagttataatgtacaaatgaagtgggttttttctaaagaataaagaagaatatatggatgttcttctttttttttgaataaaaagcactgataaaatcaagataaaatgaaaaaataaataaatttgaacttcaaagtatttacattttgctttcttcgtgtataatacaaatcgtattcaaggaggaaagtaaaatggattttgaaaaagtaaaagagatcattgttgattcattaagttgtgatgaaagtcaagttacaatggaagcaaatttaaaagatgatttagaagctgattctttagatgctgttgaattaattatgcaaattgaagaagaatttgaagtagaaattccagatgaagttgcttctaacatgaaaactgttaaagatatcgtagattatattgaagcaaacaaatagtaaagaggtgtcgctgaggcgactatatattttataataagctttgaatttcaaagcttattattttactatatgctttgaacttcaaacaaaggagaatgctatgaaattagattttattaaacaaattatgagtgagtttgatcaatcaaatgtcactaaaatgaaagtagaaatagatgatttaaaaatagaattagaaaaagaaagtgaaaaagttgaatatgtaaaaccattagaaaaagaaaataaaatggttgcagaagtaaacactaaagagcctacaggtacgcctgtaaaatcaccaattgtaggtgttttctatggtgcaagttcacctgaaagtgatccgtatgttactgttggaaagacagttaaaaaaggagatattgtttgtattattgaagcaatgaaggtgatgaatgaaattaaggcaccatgtgatggaacggttacatcaattcttgtagaaaatgaagcgcttgtagaatatgatcaagctttaatggttattgaagaaaatgtttaaaaagatattgattgctaatcgcggtgaaatagccgttagaattattcgttgttgtaaagaaatgggaattgaagccgttgctgtttattcttcagcagatgccacttctttacatgttcaattagcagatgaagcttactgtattggacctgctaaaagtagtgagagttatttaaatatggaaaatattttatcagtagctactttatcagggtgtgatgcaattcatcctggatttggttatttatctgaaaattcgacgtttgccagacttgttgaaaaatgtggtatgacttttattggtccaagtggtgatgtgattgatcaaatggggaataaaagcgttgctcgacaaatgatgatcgaagcaggagttccagttgttcctggaagtgatggcagtattgaatctgtcagtcaaggaaaagaaattgctagaaagattggttatccggttttaattaaagcttctgccggtggtggtggaagaggtatgagaaaatgttttaaggaagaagattttgaaaatgcttatttaacagctaaagcagaggcaaaggcttgttttggtgatgatgatatgtatatggaaaaattgattttaaatcctaaacatattgaatttcaaattttagctgatcattttggtaatgttattcatttaggagaaagagattgttcaattcaaagaagaaaccaaaagatgatggaagaatctccaagtaaagctttaagtcaagagcttcgagaaaagatgggaaatgatgctatcaaagcagctaaaaaagtaggatatgttaatgcaggaacgattgaatttgttttagcaccggatggaaaatattattttattgagatgaatacgcgtattcaagttgaacatccagtaacagagatggtaacgggggttgatttggttcgtgaacaaattagaatagctgcacatttaaaattgaattataaacaaagtgatattgaattaaagggacatgcccttgaatgtcgaatcaatgctgaaaatcctcaagaaggttttagaccttcaccagggattgttagtagtttacatattccaggaggttttggggtacgtattgatacaactttatatcaaggttatcaagtgtcttctcattatgattcaatgattgctaaggtaatcgttcatggaagaaatcgtattgaagcaattcgtaaaatgcgtagggtcttaagtgaattagtgattgatggtattgatacgaatcaagaattacagtatttgattttacatgaaagtgattatgtcaaaggaaattttgatacaagttttattgaaaaacatttagatgagttggtgaatgaaagatgatggaacagttatttaaggaaagaaaagaaaaacttcatttatttaagtcattaagaaaaaaaagagaaaatgaaagaaaagaagttcctgaaggactttatacaaaatgtccaaagtgtaaagaattgattcttacaagtaaacttaaaaaaaatatgtcagtttgtcctcattgtggaaatcatttaaagatcactgcttatgaaagattagaaatgatttatgatcaaggaaaatataaagaactctataaaagtacacaaagagtaaatcctttagaatttcccggatacgatgaaaaattagaatttctacaacaaaaaacaggtttaaatgaagctgttgttgtagcaagtggaaaaataaatgggacaaaggtgattacttgtgtgatggattcacgttttttaatgggtagtatgtcttctattgtaggtgataaaatcacgaaagctattgaacatgcaaccaaaagaaagtatccactcattatttttacagcttcaggaggcgctagaatgcaagaaggaatttattctttaatgcaaatgacaaaaacctccgcagctcttgctagacatcatcaagcaggtttactttatatttcctatattacccatccaacaacaggaggagtaacagcttcatttgcaagcttaggagatattattattggtgaacctcaagcattgattggatttgcaggaagacgtgtcattgaaagtacgcttaaacaaaaattaccggaaaactttcaaacaacggaatttatggaagaacaaggatttgttgatttaattgtgaaacgtcaagaaatgcgttcaacacttattagaattttaaaaatgcatggtaagggggcataaagatgtctttaagtcaagtagaaaaagaaattgaaaagttacaaaaagaacttcttgattgcaatcaagaaagaaaaaaagaaatcgaaagtcaaatcaaaaaacaagaagaatattatcaacatctttcaccttatgatcatgtttatcttgctagaaaaagtacacgaccaaatattaaagattatatcaatcatctctttgatgattttattgaattacatggagatcgtttagcaaaagatgatggttcaattgttggaggcattgggttatttaaccaacaacctgtaacaattatcggtcatttaaaaggaaaaactttagaagataatttaaaatgtaattttggaatgtcttcaccagaaggctatcgaaaggcaatgcgcttaatgaaacaggcagaaaaatttaaacgtcctattattgcttttgtcgatactccaggagcttatccaggaatggaagcagaaatgcatggaattggagaagcaattgctcgaaatcttttagaaatgtctcttttaaaagttcctattattactattgttattggtgagggaggttctggaggagctttggctttaagtgtgagtgatcgcttagtcatgttagaaaatagtgtttattcgattttatctcctgaaggatttgcttctattttatggaaagatcaagaaggaaagcgtgttgcagaggctgcaagcttaatgaaattaacagctaaggatctttatgagcgtcatattattgatcatatcatagatgaagatttaaaaggggctactgttgaaagttatgaagtttatcgacaaataaaagaatatttaaatacaaatcttaaagaattacaaaagttatcaacatctcaattgattaataaacgttatgaaaaatatagaaagataggacaagtattttaaaggagaaaaagatgaatggaattgaaattgtttctacaggttatgccaaaattgaaaagattttagataatcaacaacttgaacaaatggtagaaacatctaatgaatggattgtttcacgaacgggtattttaaaaagacatctttcagataaatcaagtgcctttctagctattgaagctgctaaaaaagcaactcaaaatcaagatttaagtcaacttgctttaattattgtagctacgatgacaccagaaaataatacgccaagtaatgcctgtcttgtacaaaaagctttaggtttaaatcatcaatcaatgatgtgttttgatattaatgttgcttgtagtggttatgtttatgctttaaaagttgctcaaagcttgttagaagaaaatcaatatggacttgttattggaagtgaacaattaagctctattgtagattatcaagatcgtaatacttgtattttatttggagatggtgcagccgctacgctgattaaaaaaagtcaaaagcttttttatagttatttagatagtgatggaaatgaagaagtactattttctaaaagaaatggttatttaaaaatgaaaggtcaagatgtttttaaatttgctattaaagcaattcctttaagtattgatcatgtcttaaaccaagcaaagatgacattaaatgatattgattatgtaatttgtcatcaagcaaatgaaagaattattaaacatgtttataaaaaatatcaatgttcaagtgaaaagttttatatgaacttacaagaatatggaaacacctcagcagcgagtattccgttagctttagcgaagatgaatgaacaagggttacttcaaaaaggaatgaaaatcattctcgttggctttggtggaggacttacttggggtgcaattttaatggaatggtaaggagaacaaaatgaaattaaatgagttattaaatattaaatatcctattattcaaggaggaatggccaatattgctaccggtgcctttgctgcgagtgtttctaatgcaggaggtttgggtttgattggagctggaggaatgaatgctgaaatgttaaaagcagaaattcaagcatgtaaaaaattaacaaatcaaccttttggtgtcaatattatgttactcaatccagatgccaaagaaatggcacaaatcgttattgatgaacatgtcccagttgtgacaactggtgctggaaatccaggtgtatatataaaaatgtggaaagaagcaggaattaaagttttacctgttgttcctagtgtggctcttgctaaaagattagaacgtgcaggcgtggatggtttaattgttgaaggttgtgaagcagggggacatattggtgaggcaacgactatggcgcttgttcctcaagttgtaagtaatgtttctattcctgttattgctgcaggaggaattgccagtggcaagcaaatgttagcggcttatgctttaggtgcttgtggtgtacaaattggaacagttttactcgcaagtaaagaatgtccaattcatgaaaattataaacaagcgattttaaaagcaaaagatacttcgacaactgttacaggaagaattaatggaacaccagtaagaatcttaaaaaataaaatggcaaaagcttatattcaaaaagaaaaagcaggagcagatatgatggaacttgaaaaatatactttaggttcattaaaaaaagctgtttttgaggggaatgttgatgaaggttctttgatggcaggacaagttgcaggaatgattcatgaaattaaacccgttaaacaaattttagaagaaatgatgagtgagttaaaagaaacttattcaaatttggagatttaaaatgttagaaatcaatcaaaaaagcctaactgtccctttaattcaaggaggaatgggtgttggtgtttctctaggaaatttggcaggacatgtagctcaagttggggcgatgggagttatttctacagcgcatccaggatacaaggaagatgattttgaaagtaatcatcgtcaagcaaatattcgtgctttaaaaaaagaaattttaaaagcacaaaagctttctcaaggaaaaggtttagtagctatcaatgcgatggttgctttaaaagattatgaggaattgatcaatgcagcattagagagtaaagttgatgctattatttcaggagctgggcttcctttacgtttaccagaattggtaaaagatcatgatgttttaattgctccaattgtttcaagtggtaaagcctgtaaggtaatcataaaacattggctcaaaaaatatcaacgtacaccagattttattgttattgaaggaagtcaagcaggaggacatttaggatttaaaaaagaagacttagaaaatcaaacatgccaaagtttagaagaaatttttaaagatgttgaagaaattgtagaaaataataaattgaacattcctatttttgtagcaggaggaatcagtcaaagaagtgatgttaagcatttctttgatctaggtgtcgatggtattcaagtagcaacacgttttattacaacgtatgaatgtgatgcttctatcaaatataaagaagccttcttaaaagctataaaggaagatattggttttgtttcttctcctgttggaatgccaggaagagcaatgcaaaatagttttgttaaaaaaatcaagaaagaaaaaatacctgttaaaaaatgttatcaatgtttaattccttgtgatgttaaaaatacaccttattgtatttcaagagctttaatagaagctgttaaaggaaatttagaagatggtcttatttttacaggagctcatggttataggcaagatcatttgatacatgttgatgaagtgattcgtgaattaatggaggatgacaaatgaaattaggaattatttatgctggtcaaggaagtcaagttgtgggaatgggaaaatcattttatcctcgtgaaatctttgatcaaaatgaagatttaaaggaattatgttttaatggaccacttgaaaaactatcttatacaccatatacccaaccatgtatggtgatggttgcaacaatcattacagatttattaaaagaacatggaattgtgcctgattatacagcaggtctttctttaggggaatattcagcattatattgtgcaggtgtttttgaaaggaaacaagttattgatcttgcacgttttagaggaaaagtcatgcaagaagcagtatcaggaattgaaagtgaaatgattgccgttttaggaatgaaggaagaacttttacaagatttatgtcatcaagcaagttcattaggagttgtttctatttctaattataattgccctggtcaacttgttgttgctggtgaaaagaaggctgtggaaaaagttaaagaattagctttagaaaataaagcaagaagagtgatttctttaaatacgagtggaccttttcatacgtctttattaaaagaagcgtcacttgctttaaaagaaagatttaaaaaagaaacttttcatgaaatgaaaatacctgttatttttaatactttaggtcatgaaatcgaagatcaatcaataccagaaattttagaaaaacaagtgatgtcaccagtctactttgaaaaaagtattcgctatatgatagatcaaggtgttgatacgatcattgaagtaggaccaggaaaggtattaagtggttttgttagaaagatagatcgaagtattcagctttatcaaatagaagatatggagtcattgaaaaaaacagtgaaagctttgaagggagaataaaatgagattagaaaataaaattgctcttgttacaggtggaggacaaggtattggtaaagaaattgctaaaacattagctttaaatggtgcttttgttttaattaattatatagatttagggaataatcaagaaattgctcaaatgacaaaaaatgaaattgaaagtcttggaggaaaatgtgaaatcttacctgcaaatgtagcaagttatgatgaaacattagagatgtttaaaacaattaaaaatgaatatggaagattggatattttaattaataatgcaggaattacaaaagatggcttaatgttacgcatgaaagaaaatgattttgatgcagttattgatgtcaatttaaaaggaacatggaattgtatgaaacatgcgacaaaattaatgatgaaacaaaaatatggacgtattgtttccatgtcatctgttgtaggcgttatgggaaatgcaggacaagtcaattatgctgctagtaaatcaggaattattggaatgacaatgtctcttgctagagaagttggaagtcgtggtattactgttaatgcagtagcaccaggttttattcaaacagcaatgacagatgttttaagtgatgaaattaaagaacaaatgaaaagtcaaattcctttaggaacatttggaagtgttcaagatattgcaaatgcagttgtttttctagcaagtgatgaagcaaagtacattactggacaaacattgcatgttgatggtggcatggctatgtaaaggagaagcatatgaaaagaagagttgttgtaacaggaataggtgctttaacacctattggaaataatgtaaatgatacatggaagggtattttaaatcatcaatgtgggattgatttgattcaatcatttgatacttcaaatatgaaggtaaaagtagcaggtgaattaaagaactttgaagctactgaatatttagataaaaaagatgttcgtaaaatggataaatttattcaatatggactgattgcagctaaagaagctatcaaagattccaaattagagatagattctataaatcatgatcgttttggggtagtagtatcaagtggtattggaggattaggatctattgaagaaaatcatcaacgtggtttaaagaaaggatttgatcgtgtttctccatactttattcctatgaccattgttaatttagcagctggtcaaattgccattgcctttaaagcacaaggacttgctacatgtcctgtaacagcttgtgcgggaggaacaaatgctattggtgatgcctttagaaatattcgtgatggttatttagatgtaaccattgctggaggttgcgaagcaagcattacacctcttggtattggtggttttacatcaatgaaagctttaagtgaatcacatgatcctaaacgtgcctctattccttttgataaagaaagaaatggttttgtcatgggtgaaggagcaggaatgcttgttttagaagaacttgaacatgctaaagcaagaggggcacatatttattgcgaaatggtaggttatggtgttagttgtgatgcttatcatatgacagctccagctcctgaaggtattggaggtgctaaagccatgatcaatgcacttcaagatgcttctcttgaagctaatcaaattgattatattaatgctcatggaacatcaacaccgatgaatgataagttagaaacggctgcaatcaaaaaagcttttaaaaatcatgctcataaagtagctgtatcttcaacaaaaggaaatacaggtcattgtttaggagctgctggtggaattgaaggtgttttatgtgttaaagcattagaagataactttattccagcaactattaattatcaaaattttgatgaagaatgcgatttagatattgttgcaaatcatggaagaaaacaagtattaaattatgtaatgtcaaattcattaggttttggagggcataatgcctcaattatttttaagaaatatggagaagagtaatggaacttaatagtaatcaaatacaagaaatcaatcctcatcgttatccttttgctttagtagatcgaattacagattataaaccaggtgagtatgctaaaggaatcaaatgtgtcagtgttaatgaaatgcatttttgtggacattttccaagtcatcatgtcatgccaggagttttgatcgttgaagctttggcacaagtaggatgtattgctattttatcaaaagaagaaaataaaggaaaaattgctttttttggtggtattaaaaattgtcgttttaaaggacaagtaacaccaggggatgttttagaaatggaatgtgttcttactaaacaaaaaggacccgtaggaattggtgaagctattgcaaaagtaaatggtaaagttgtttgcaaagctgaacttacatttgcaattcaataatcttgaattgcaattttttttattttatcatgataaagaggtgacattatgaaactgattgaacttgaagaagttgattcaacaaatgattatttaaaaagagaatataaaaatttacctatgcaaacatgtgtcactgccaaatatcaaacaaaaggtagaggtagaaatggtcatgtttgggaaagttatgcaaatgagaatttgattatgagttttttatttaaagattttcataaaatagaagatgcttggaaaatgacacaattagcaacatgtagtgttgttggtttacttgatcgttatcgtattaaagcaactattaaatggccgaatgacatttatgtcgatggaaaaaagatttgtggtattttagtagaaacgatcttagatcctgatttaaaaggagttattgtaggaataggattgaatgttaataatgaagattttcaatcaatgaaacaaattactcataaagagtataaaatatctaaacttgctattggactgaaaacatttatgttgatttattataatttatatcaaacaaatcagtttcataaggttttagaatacgctaatagtatttcttatttaaaagatcaatgggtagaatatggtgattatggagaagtttgttttcaaaagctattagatgatggttctgttttatttgttgatcgacaaggaaaaacatataaacaggtaattaatgaaatatctttacataataaataaaagtgcaggcttaagcttgcacttttacaatataacaatatttcttataaaaggatatgccatatccttttacatgaagatatccctcattgatgatttcttcttcatatttattatcaatgatttgttgggctccttcactggaatccttaattaaatccttaacactcttagaatgtttacattctaagatgagtgctgtctgaaagatttgtttaggaaagatacatagatcaaatcttccatgcaccgcttctcgatttgatttgatctttttaccactaaagagtcctaatagaaaaccatgataaaaagattcttcattatcaaagtaattaatacttctagataagatatctcctagtatttcatttgcatgatcaacgtctcctttaacaagactttgataaagattttcttttcttacaaaagtatagtcttcaaaataagacatgaatgtttgtttatagatttcatagacttctttattgggaataatcagtttatacttattttctcctaaatcttcttttatctttaaatatcctgtaagtaaaagaaaactatagatattattaatattatccatttctcgataagtaagttcaggtttgatatatttcgttaaagactttccttgaatgagttgttcaaattcttcatgaagttcatcactgccattttgaatatagttgacaacaagatcatttccactggtatttgcccagaaggaaataggtttgttatctgagctatttaatttacagtcaacatacataagtgtactccaaggattatagatttcgatgtttccaaataaataaccatcataccattctttaacttcatctacataatctgatagattataatcttttaataattgtaagatttctttttttgtaaagccaaaatactcattttttgatttataaagaatagaataggctttaaaattatttaaaccggtgaagatactttctttagaaatacgaagacaacctgccaagattcctttttctaaagcatcattggttttaagtgctgaagaaaagacacttcttagaaattctaccatttcatcatagtagttatattgataagcagcttgtaaaggaacatcatattcatcaataagaatgatgactttttgatgataatgtttataaagaaaatatgagatattgaataatgatttttctaattcattatcttctgtttcattatcaacatatttttgaaaaagtttcttttcagaagctaataatctctcactattaagcaattcaagatgactttttgcacacaaacaaataacttctttaaagcgattcatttgtttttcataggaactatttttcatatcttttaaagtaatgaaaagtgttggatattgattttgatgttttatagcttctttatttttagaaatgtttaatccgttaaaaagatatgcattttctttttccttgatagaaaagaaataataaagcattgacatatttaatgttttcctaaatcttcgaggtcttgtaaaaaagacactctgttcgtttaatatattttcaataagatttgttttatctacataataagcatttttatcaatcatttctttaaagttttcaattcctataggtactaatttcataaattattcatttccttatgtttaatataattttaattagttaaattatatattgttgtaaactaaaaatcattggacagattgtccaatgatttgttggaataaaagatgaatatatgaagaattatttctttgataatatcgagctataagaatgagcataatataaaagtgtacttaatgagtacacaagttgttaactaagctttagtagtaacctctcgttataagggttcagggagactagagcttttattttatataaaaatacctccagtggaggtattttctatttgatatagtgtagttcttgtaatttttgatagacttggtttgcaagtaattgattgaatgtatcattacctgcgaatttgtcttcttttagaagacttgatgggatatagctatttgtaagatctttttgatcttgttcagtagctgtaatatttgcatcttttaagccatttgtaagaagataagttctaaagtctaagaaatgatctttatgttcttcttttaagacgttattatcgtctcttacaagattgttttgtctttttgatgtcattgatacaacaatgtatttttgtgttttaatttggtttaaaatagctctttgataagtgattgtacgataaacatcttggttgttttgtttatcatagtttccagaaaagataataacgatatcattttcattgaattcaggaagtgttgcttcgatttgtgcaggagctgttagggtaacagcttttccagatttctctcttgtaaatgtatgaatattacgagatgaatcgtaagctaaagttcctttaataccttgaatggtaacttcatcgaagtttgatccactattttttaaagcttctacttgttcacctttttcattatagaaagtaaggtctacagcttctttatcaccagggatggtgatattattagcgaaaatctttgttcttcctacacgaatagataaatcaaaagttgtatcttggtttccaccgaatttaataatttcactatttgtaagtgattctaaattaagtgggtaactagcaaattcacttcccaaggtaaaggtatcaccaatacaataaatacgttgactattttttttcttttttgtttttgtttttgttgtttcttcttttgttgtagttgttgttttttcttctgattggtattttttagcgttttgacttgttgaaaaacggtcataaccaattaaaccaacaatcatagcaagtaaaacaacaacagtaatagaaaaagtaacttttttcatattagtaatagtagtaatgactaccagatagagattttgcttttgttaaaacacttcctaaaacgtttacattatttctttgaagtagttttacacaatttgcagcatcttttttattagtatcttgtgaagaaatagcaaaaatagtcccgtcaacggcatttcctataggaatggcatcagatatcattccaacaggagcacagtcaataataatgaaatcaaaggatttctttaattcattaatataatctttaaatacatgtgatcctaataattcagaaggattaggaatatgaatcccacttgttaaaacagccatagtacctgcaaaagaaggatcttttacactttggaagtattcaacatttaattttttagtttgacgatattcaagtaaagcatctgttaaaccatgtttgtttgataatcccatatatttatgtaaagtattttttcttaaatcacaatcaattaataaaactctattatattttgttgcaaaaatataagcaaggttaatagatagtgttgtttttgcttcaccagcttgtgatgaagtaatacaaattgatttaatgtctttgtctactgtagaaaattcaatgtttgtacgaatatgacgaaagatttcagtataatcaaattggctatgttttttatttttatctaaaatatttaatgtttttcttttacttgttttttttgccataattatctccttttaaatatttttttaaagaaggatgtttttccttcaataggatcaacttcttcattgttgatgatatgtagaggattttcatacattaatgtatgaatatcttcataactatatttctttacaagtaaatcaaagacttcttgcaaacaaggagaacgatgtccgtcacaacgatgagtatccgttgcaattacatgaagtaatccttgatttaataattgataagcaaacttttgagcatgtttaccatgatatcccaaaaagcttgttgcattaacttgaataagataaccattatctataaaatcttgaattctttcgatatctaaagaatctttaaagtatctttcaacatgagcaataacgggagtatattttttatattgaatttcataaagacgatcttctacttcattttcatttcctaattcttttctaacatcaaattctacaagtaaataatgggtattttcaataggtataaagatgttttgttcaagtgcttctagataatcatgatttaagaagagttcacacccttctaaaacttcaatattataaactctagcaagctcttttaaatcatgaattctatctttaataatttctaaatcttttaaagtatgttttccagaaacaacatgaggtgttgcgacaatcgtagaaatacgattatttttagctttttctaaagcctttttagcatcttcaagtgatggcattccatcatctatatcccatgcataatgaccatgtatatcaataaaagccataactaatcctcaaaataaggaataacgccaagatttggaatttctaaatatttttcaacgtcttctttagtatgtaaacgattatctaacatgaatctaataaagataataccaatacttaaaatagcacctactaaaccaccaataactatatttttaggaacacttggtgaaacaggtgatgtttgaagttttgcatcatcaactgttgtaatattgttgatatttaaagtttcttttacttcatttgtgaagacatcaactgttgtatcaacaatttttttactgagttgtggatcagttgttgttgctgaaatagaaataatttgggtatctgtttcatttgaaatagataaagcagaagaaacaacatttgtatcaacgtttaattctttagcaactttactttgaatattgtttcctccaagtaaagctatatagtttttagtcatcgaattatttgagttaatttgtgaatagtcaacgattccttcgttaacttctggttttgggaaaatacgagccgttgattcatattttttactaacaaagaaaatagtaaaagctcccactaatatagcacaaatcaatgttgaaataataatgatatgtaaatgttcttttaatacttgaaacaattcagctaaattaatttcaatctcttcattttggatttcttgattatccattacttaatctcctttaatacatatttttataaacaattatagatactacgtcgaggctcattatctaacaaaagcctttaaaaatcaacagaattagatttttttatagaagtcttattatatatggaaaggaaaagtcataaatttgatcgtttggttataaaaatcgaccgttcagtaattatttattgataatttaaaaaatcacggtataatacgtttgattatagatgaactccaaaatacgtcgtattaactttaaaaattgaggggggggggtacaaatatgtacaaaaataagagtcaattattatttagaagactatgtttgatagtagtagatataataagtattattttatctttcttcttatcagcatttattgcatatgacggttctatggaattaagctttttaaaatatacttatttttttatacctattttactcataggaagtctattcttctttattataatgaagctttatgatagtttatggagctatgcttccattaatgaattattaaatgttattattgcttcaatatgcagttcaattttatactgtattttatgtttgctcattccagtccatccgccgataagtacaatatttttatatttattattattacttgttttcataggtggaagccgatttggttatcggtttgttcgtctttatgcttcaagacattacttatttggtagaagtgatgataatgaaagcaaagtcatgattgttggtgctggttcagcaggtgaaaagattttaagagaaacacttgtttcgacaaaacttcataaaaaagttgtttgtttcattgatgatgatgcaacaaaacacaatagacgcattcacaatgttcctattgtagggggaagaaatgaaatccttacacaagttgaaaaatataaaattgatgaaatctatgtagctttaccatcaatagatgataaagaaacatctaagattttaaatatttgtaaagaaaccaaatgtaaaataaaaaaattacctggtatgtatcaattcttgaacgatgaaattactttagaaaaactaaaagatgttgaagttcaagatttacttggaagagatcctgtccaagtaaacttaaaagaaattatgggttatgtaaaagataaagtagttatggttactggtggaggaggatctattggatctgaactttgtcgacaaattgctgcaagtaatccaaaacaattgattattgtagatatttatgaaaataatgcttataacattcaattagaattacaacataaatatccaaacttaaatcttgaaaccatgattgcttccgtaagagatgctgttaaaatcaatgatttatttgcttattacaaaccagatatcgtttatcatgcagcagcacataaacatgtaccattaatggaagatgcgccacatgaagcaattaaaaacaatgtttttggtacatacaatgtcgtaaaagcaagtcatacatatggtgttaagaaatttatcttgatatctacagataaagcagttaatccgacaaatattatgggtgcttcaaaacgattatgtgaaatggttgtacaatcttataacaagatttcaaaaacagaatttgttgctgtacgttttggaaacgtattaggttctaatggatccgttattcctttgtttaaaaaacaaattaaagaaggtggaccaattaccattacacatccagatatcatcagatactttatgacaatacctgaagctgtctctcttgtcttacaagcaggtgcctatgctaaaggaggagaaatctttgttttagatatgggaaaaccggttaagattttagatatggctagaaacttaattaaactttctggtttagaaccagatgtagatattaaaattgaatttattgggttaaggcctggtgaaaaactttatgaagaaatgttgatgaaagaagaaggaatgaaaacaacgcctaataagatgattcatattggacaaccaattcaattacctgatgatttctttgatcaattagaagatttacgtcaaagtgcttttgatgaagatagtgatattagaaaagatgttcaacatatggtagatacttaccattacgatgaaaatacaacacatggtataaaaaacaaaggataaagagttaaacgaatcgtcgctttgtcgcgttcgtttactttatttagaaactcgtatttatatgttttaatatgtcaaattaatgaaaccgtaatcaatcacggatcaaaaggttgatagaaaggaatgtatattgtagcttattgcatagataagtcaattacagtatgctagatgaatagaaaatgaaacttgcagtttcaggaacaggatatgtaggattgagtatcgctacattattagcacagcatcacgaagtgatggctgtggatatcatagaagataaggtgaataagattaatataaaagtacaaaaagaagctgatgatttatatgacagattggttgaagaatataaagtcaaatggaatgttactgaagaacttaaaaaaaagaatcaaattaaatgggtcttaatgatgaataacattaataattgtgtatatgaaattattaataaagagattattaaaatttaggatagtataaaataaaaaccaattcggattatccatgaattggtttttatttggttacccttttatttttgttaatgctaagataaatttccagatgggctacatgtgagtgtgacagttcttgtaacgtttacgcctggtgcatgtcctgtaacactagctatggctttgttgccactttttgaagcttttttattacttaatgaccacatagaagatggctttgttgtacttacagtagcttttgtacaagtacatgaagaaccattataagaaaaagttccagttaccgaaatagaccacataacttctccagatgcatttttgtatttttctgtttttgtaccgctcttgctgcttcttgctaatgtatttatgtttgaaacaattgttgtttcaatataatcaccatttgataaatattcgatactcatgttttcttcaagagcatttactggaatgatggtagtaatcatcataaatgcaatgaagatagatgtaattatttttttcatagtttcctccattttttaattatcagaaatggttgtttcaatttcatatatgatggaatttttagcatcttgcatatagctgtaccaaagaaccccaaaccaaatcgctaaaattgtgcagattactgagaagaatataagaaatttttgtaaaattgtctttaatttcattcttttaataagatcgttttcatcgctgctttgtatatattctacaacaatgtctttaggttctccaaattgttgaacaatatcgtcgtatgaacattgtgggtgatcatctaaatattcatttaagtgtttttttaattcacttacataaaatttttcctttttagtatgcataggcataattgtccaaatatttttaatatattttttaatattattcataagcttcccccaaagattctttaataacattgtgaataccatcaacagcgttattaaactcattaatcatttctgataatttttctttacctttttcttctatgtgataataaactcttaccttacggtcgattactttttcgtaatttgaaatataattctcatcttgtaatttatacaagataggatacatggtcccttccttaatatctattaattcatgggaatatgttttaatttgctttgtaatttcataaccataacaatcttgtttggcaattatacatagaagtaacatagtacattgtgcgaaaatagctcgttgccagttccttcttttttttatgtttttttattcatcaaaaaaaagttctcctgtatgagaacccttataacatattttctaattcttttaaatcatggataatataatcaatttttatggatgttttatcatgttgtggattataccaacatgtatcaatctgtgcatttataccgccttgcatatcacttgtaagagaatcaccgataataagtgctttatctttatcaaagtgttcaatatgtctaaaacagtaatcaaaaaactcaattttaggtttttgatacccaatttcttcagagataaaaatatctttaaaatatttatttaaatctaataactttaaacgattatattgcgtactagccacaccatttgtcacaacataaagatcatattttttagaaagatattctaatatttcaatggcatgtttaatcaaataggcaccatgccctaaattccattgatattcatcttcaaaggctacaccatcttcttcgattccaagttcattaaataatttaacaaagcgcgtataaactactgtttttttatcaattaatcctaattcaaaatctttccataattttgaatttatttcttcataaatttcaaatatttctgatgttaattctaaatgatgatcactaaatgttttatgcatagcatagtcttcagcttttttaaaatcaagtaaagtaccatctatatcaaataaaagtgttttatattctttcataaattcctcctaggtctttattatatagaaaagtttaaaaaaataaataaaaaagtgtatacaccataaataatcagttaaatattatttataaaataacttattactttttttgaatttttgttatatatttagataagatattttactatatttttatgaaagaaaggagatgtaaaatgggcatttttttagcgatagatcttaaatcattttatgcttctgtcgaatgtattgaaaaaggttatgatcctttagatacaaatcttgttgttgctgatgctagcaggacagaaaaaacaatttgtctagctgtttctccttctttaaagaaatatggtatttcaggtagagcaagattatttgaagtaatccaaaccattaacagagaaaataataaaaggctaaaagaaagtcattattttaatggtgaatcatgcttagaaagtaaactccaaaaaaataaacatttaaaaatagcttatgaaatagcaactccaagaatgtcccattatatgaagtggagccaagaaatatataaaatttatcttaaatatgtttctcctgaagacattcatgtttattcaattgatgaagtttttatggatataacacattatactcacatttatcaaaaaacacctagagagttagcttcccaaattttaagtgatatttatgaaacaacaggccttatagctacagcaggaattggtacgaatttatatttatgtaaagtcgcaatggatatagttgctaagcatataaacaaagatgataatgggcaacgtattgccttacttaatgaagaaagatatcgaaagtatttatggaatcatcgtccaatcactgatttttggcgagtagggaaaggatatgctaaaaaattagaaaaagaaggactttatacaatgggagatatcgcaaaatgttcacaaggtacagagaatgaatattataatgaaaaacttctttatgatttatttggtgttaatgctgagttacttattgaccatgcatggggttatgaatcatgtacaatgaaagatattaaaaattataaacccgaaagaaatagtattggaacaggtcaggtattaagtcgtccttataattttgaaaaaacaaaattgattgttaaagaaatgttagatttgttagcacttgatttagtagaaaaaggattagtaaccaatcaaattgttctaacaattggttacgataaagataacgattatcaaggagaaatgatgatcgatcgttataatcgaaagattcctaaacatgcacgtggaacaatcaatttagagcgttacacttcatcatcaaaatcgataattaaagaagtaataaagaaatttgatgaaatagtaaataggaatttaatggttaaaagaatcaatatttcagcatccaatgttttatatgaagataaagtaaaagatatgatttatcatcgacaattgaatttatttacaaaccatcaaaatataaatcaaaaagatgaaaaagaagctttagaaaaagaaaaaaatttacaaaaagcaactcttaaaatcaaacaaaaatatggtaaaaatgcaattcttaaaggaatgaatttagaagaaggagcaacaacaagagaaagaaatgaaattatagggggacataaagcgtaatggccacaataaaaaatattcatgattatagtgatatcataaatcgtccttataaaaaatctaaaaagtataaacatatgtctcaaaaagatcgtgcagcacagtttgctccttttgctgctcttataggacataaacaacttattcaagaaacccaaaggctaacagaagataaaaaggagcttgatgaaaataaaaaaagtgttttaaatcaaaaattactttattttatagaaactaaagaaaagataaaaattacttactttaaaaaaaatcaaaaaaaatcaggtggagattatttgacgaccattcaaagaataaaaaagatagattcaatttataaaacaattactcttcaaaatggtcaaattattaaaatggaagacatttatgaaatcgaacaataggtcatattcgttgaatcccttatttattagagatataatatttgtaagaaagaaggggtgaatatgaaggatatgaacgcattaaatcataagttacaaaccatgacaagaaaggagttaggggcaatttgtaaatcacataattgtaaaatcaatgatgataatttatcgattgctttacatttgatgaagaataatccttcatcaatcctaatcgaagaatatcaaattatatttcttattgaattaaaaaaagaaacttctaaagaaatatcagatgaattcaaagatatcttaaaacatgatttcattcatgaaatcgaattacttcattaatagcacataagtgctatttttgtttaatcaaaatgctatttatatgctataatgatgaaaattgaggagaaatttatgaaaaaaattgaaaataccgttataggttttattttgatcattattggagttattatcggactaaatgcttttcatattacaaatatagatttattctttgatggatggtggacgttatttattattgttccttgtttttttggtttatttaaagatcaagataaaacaggaaacatcataggtttgattgtaggtatctatttattactttattgtcaaggattaataaattttcaatttgcatggaaattagtggttcctgttatctttgtattcataggattgaaaatgatttttaaagatacttttaccaaaaagaaaccacatcaaaatatttatgataatcagttatatacaggtggaaattatgatgtcacttttaatggattaatattagatttatcaaaagcctatttaaatgaagaaacaacaattacgatttcaactttgtttggtggggttgatttatatttgccagatgatgtaaatattcaaatacaatcatctaattttttaggtggtgtcgattttcataaaagagaaaataaaatagaaaatacaaaagttatttatcttaatgcacgttgtatttttggtggtataaatattaaataaaaggggttaatagaatggaaagaaattatccagagattattatttcagatgaaggtgttacttggcttgataaaggtcaaatgtggatgtataaaaataatttagaacaatgtgatcctcaaataaaaaatggtgaacttgttgatattgttacaaataaaggaagatatttaggaacaggttttatttctttaaaaagtcatattacggtacgtattttatctaaagatagaaaagaaataattgatcgtgaattttttaaaaagagaattcaacaagcttatgattttagaaaaactgttgaaggagataatttatctaattgtcgtttaatttttggagaagctgatttattacctggacttgtgatagatcgttataatgatattttagtaagtcaaatcagttcttatggtttagaacaaattaaagatatgatttatgaaattgttttagatgtcttaaaagcagatggagaagatgttaaaggtatttatgaaagaaatgatatccaaattagaactaaagaaggtttagaacaatataaaggctattataaaaataaagatttacctacacaaacaattattaatgaaaatggtttattattacatgtagatgttgaaaatggacaaaaaacaggatattttttagatcaaaaatcaaatcgttatttacttagaaaaattgctcatggaaaacgtgttgttgattgtttcagtcatacaggcggttttgcattaaatgctgctatgggaaatgctagtcatgttgtttctgttgatgtttctaaaacagcattagatcaaggctatcaaaatgctaaacttaatcatttagaagaaaaaattgattttgtacaagcagatgtctttgattatttagatgaattaaaagaaaatgaatttgatataattgttttagatccacccgcatttacgaaatcaagaagaactgttcaaaaagcttataatggttataaaagaatcaataaacaagcaatgaaagttttaaaaaatggaggatatcttattacatgtagttgttcacgttttatggaaacagctaattttgaaaaaatgttaagagaagctgcaagtgaagcaggcgttgttttaaaacaagtttctgttactcaacaaaatgcagatcatcctattttatggacaatggaagaaacatcttatttaaaattttatattttccaaattatttaagagttagattttttctgactcttttctaaattatttccttggaaataatttattgcaacaaaataacagaaagaatataatacatattgggtgaaaaagatggacaaaagtacaaatgcggttgcttatgcaccgggatattatattcgagatatacttacaactttaaatatctcttataacgattttgcacaaaagatggatatgaatctagatgaagtgacacaacttattttaggtgaatgtgaacttaatgaagaaattgctaaaaaattagaagctttttttcatgtagaagcatcacgttggcttactttagaaaagcaatatcgtatgacaaagaaatgatttcatttcttttttctttgctaaaatatgctttataagcataatattatctacaataaaagtattggaataataaaaataaagaagataaaatatcactatacatttaagttatagtagattacacaattattattgtacatcttgaattaaaagaaatagaatagtaaacaggagggataatatgaagaaaaagaaaacatttgatatgttaaatggttctatttggaacaagctcatactttttgctttaccattagcagcaagtagtattttacaacaattatttaatgcagcagatgttgctgttgtcggaagttttgcaggaagtggggcattagctgccgttggagcaaatgggccaatcattaatttacttgttaactcatttgtagggttatcaataggtgctaatgttgttattgcatcatttataggacaaaatgatgaaaagagaacatcacttgcagcacatacttcaattttaatgtcggtgattattggaattgttttattgtttgtaggattctttttcgcaagacctattttagagttgatgtcaacaccagatgatattattaatcttgcagaagtatatttaaaaatttattttattggggttccttttgtcatgctctataactttgctgcagctgttttaagaagtaaaggagatactcaaagaccacttattgcattatttattggtggagtcattaacgttattttaaatttattctttgttgttgttttacatatgtctgtagaaggagtagctattggaactgttgtttctaatatctttagttctatgatgttactttattggttaatgcatgaaacagatgctttaagaattgatttaaaacaattaaaaatcaatgatcgaatcttaaaaagaattgcaaaaattggggtacctgctggtttacaaggcatggtcttttctatttcgaatgtttgcattcaatcatcattaaatgctttaggttcagatgctattgcagccagttcagcagctttaaactatgaatattttgcttattatatattaagttcatttgctcaagctgcggttacatttattggacaaaattatagtgctaaaaaatatgaccgttgtaaaaagattacacttcaatctttcttattagggggagcaacaacaatggttgcttgtatgatatttgtaatttttgatcatttctttattagtttctttacatcagatgtttcagtagctagtttagcttatacaagattgaaaatcattttaccattccaattccttaacatgtcaattgaagttttctcaagtgtaatgagaggtgttggttattctagtgttccagcaggtatttgtgttgcgggaatttgtggagtaagacttgcttacttatatacaatttatccatcaattgcctcatacgatcatttattaatcatttatccaattagttggtttgttactgtgttagcactagcacttgtttatttcattcatgtacgcccaaaagtttatcatcatcaagcagcaaattaaggctgcttttcttatctctacgatgcgtttgtttacattttgtatgaatatacataaaatgcaagtgaggtgaaagttatgaatcaagaaaaaatagggaattttattgctcaaagaagaaaagataaaaagcttacacaagctaagcttgcaagttatttaggaattagtgatcgtacaatttctaaatgggaaagagggaagggtctaccagatcctatgtatatgttagaactctgtcgaatattggatatttcagtcaatgagctgttaacgggagaatttatcgaagaaagaaattaccaacaaaaagcagaagataatttattgatgatggcagatcaagaagtaaaacaaacaaagaaaatgttcttttatgaaaatgttattggtattggttcaacgagtatctttttgattttaatttttatatctgtttattttgttgaaaacagtgtattaaaagtcatcttgtttatcttaagctttatctttttgattattggtgtatcaattgctttaaaaatagaaacagaagaaggctattatgaatgtcaaaaatgtcatcataaatatattccaagctatcaacaagtttattttgcaatgcattatggaagaacaagatatatgaaatgtccacattgtcaaaaaagaagttggcaaaaaaagatttattcaaaataaaaattcgttataataaagatataaaaagaaaaggaatttgaaagatgaataaacatgtagaaaaagcaaaagaattaagaaatgctacacccatggttcataattgtgcacaaacaattatggaagtttatgccgatgatttaggaatcaataaagaacttgctaatcatttgggatgtaactttggcggtggtatgaaatgtgggagcgtctgtggtgctattaccagtggtttaatgattttaggagcaaaaggaattgattcaccagcaaaagtgaaccaatttatcaaaacaatttctaataatcatcatggacttattaattgtgcagatttacttaaagaaaatgcaaagaatggtggacaaaagaaacctcattgtgatgggatgattcaagaagtaatcgaacttattgatcaaatggagaaagaaaatgattgaagaaattgaacaaggcatgattttatatactcaaggaaataaaatcaaacatgatgttgctcattttttaaaagtgcatcaatatgcacgtcttattggaaaattagagcatttagaaaaaagagaacaagaaatactcgaagtagctgctattgttcatgatatagcttgtccaatgtgtcgtgaaaaatatggaaattctgcaggatatttacaagaacaagaaggaccagctttagtaaaagatttcttaaaaaaatattctttagataaagcttttattgaacgtgtggcttatttagtaggacatcatcatacgtataaagatgtagatggtttagattatcaaattttattagaagctgactttttagtaaatggtgatgaatcgaatttaactaaagaagctatcgaaaaaatgaaaaagaatgtttttaaaacaaaaacaggaatagaactattaaatcatatttttgaattataaaatatgttataatgaaagtccttggcaggggcgtgaaaaagcaatgtgaaaacattgttttttctttttaagaaataattttgttttttataaaggctttgttataatagtcgcaaaggtaggtagaaaaatgtataaattaatagcattagatttagatggaacattaacagataaaaataaaaatattttagaagaaacaaaacaagaacttattaaattagcacaaaaaggtgttattattgttttagcttctggaagaccaacagctggtatctttaaagaagcaaaagaattaactttagatcaagtaggaggatatttattatctttcaatggagcaagagtattagattataaaacaaatgaagttgtctatgaacaaacattatcaagtgaaatagcacatgaaatgtatgatcgagcaaaagcctttggtttatctccgcttacatacaatgcaactgaaatcattacagaagatataggagatcattggattcaattagaaagctttacaacaaaaatgaatataaaacatgtacaagattttaaaaaagaagtaaactttgatgtcaataaagtattaattactggagaaccagcatatgttgctcaaattctagatgaattcaaagctccatatgaaggaaagatgtctatttatagaagtgatccttattttattgaatgtatggcaaatggaattgataaagctgcttctttagatgttttatgtaagaaattaggaattaaacaagaagaaacagttgcttttggtgatggttataatgatttatcattaattgaatattgtggatatggtgttgctatggaaaatgctgtagatgaagtaaaagaaagagcaaactacattactttatctaacaatgataatggaattgcttattgtttaaaacaattagaagaaaaaggacttatttaaactcttaagaaattaagagttttttaaaatgataaaaaaacaaatcgcttttcatagcacagaaatagaagaaatgtataccctttatcaacaagcatttccaaaaaatgaacaaatggatttaactcgattatttgatgaattacatttaggcgctatttatggttattatcaagaaaatcaacttgtaggttttgctattttatgtattcaaagtcaaatagcgcatattttatatcttgctgtaaaaaaagaatatcgtgatcaaggtataggaagctatattcttaatgatctagcaaaacaatatgattctaaaaagattattgtagatattgaaaaaattaaagatacttctaataaagaacaaagaataaaaagaaaacaattttatttaaaaaatgattttaaagaaacagatgtcttttatacttggcaaggagaagattatgttattttaagtaaaaatggaattgttcaaaaaaaagaattttggaatttttgggattccttaaagaaggagaaaaaatgaagttagttgcacctaaactatcctatatagaaaaaacaagttttgaagaatgtttaaaaaaaatgaaatttcaagatgttcatattgatcaaaatattcaacaaagaacaataattcaagatttaacttttgatggttgtctctttgaaaatattgattttactaaagtttcattaaagcatcttgatttaatagatgttacttttgataaatgtgatctatcaaatcaaaattttgatcatcaatatttaaatcgtgtacaatttaaaaactgtaaattaacaggaacttcttttattgaaacaaatttaaaagatgttttatttgatcattgtcagggacgttatagtaatttatcatcaagtcaattgttaaatgttatgtttgatcattgtgatttacaagaagcatcattttatgatgcaaactttaaaaaaatacaatttaatgaaacaaatttaatacaaagtgaacttgcttcattacatcataaaggattagatttatctacatgtcaaatacaaggggcaatgtttgatctagcaagtttaaaaggattgattattaatgattttcaagctgtagatttaatagggatccttggtgttaaagtaaaataaaaatgttgtcatttggcaacatttttatgctatataagcaagtaataattttaaagtattttctacagcttgaagatgtgttctttccataccatgactagctgctacacctgggccaattaaagcgcctttaatattttgaccaccacgtaaagcggctgaaacatcactgctgtaataaggataaatatcaatagcgtattgtaactgatgtgtacttgcaagttcaatgagtttagaagttaaatcataatcataaggtccactaccatctttagcacaaatactgacatcatattcactacaagctaaatcttcaccaatacaccccatatctacagcaatcaattcatcaatattaggatgaatataactacttccgtgtcctacttcttcataagtagaaataataataatgagattatgtttgggtttaatatgattattagctaaatgcttaagcattccaaataaaatagcgacagatattttatcatctaaaaaacgtgatttaataaaaccagattctgtaatttcagttttaggatcataagcaatataatcaccattttgaatacctaaagcttgtacatcttctttatttttaactacttcatcaattcttacatgcatattttcacaatctcttggtgcacttttagcatctttataaacatgaacagcaggataattagaaagaattgttcctgtataacattgaccatctcttgtatgaatacgacaatattcaccatccaatgtaggaataattggaccaccaacatttgtaaaagctaatgtaccatcacttttaatacttcttaccattaatcctaaagtatcaacatgtccacaaaaaccaatcgtataatcatcttgaccttcaacataaatttcaagatttcctttatgcgttttctttgtttgaaaacctaacttttcagcttctttttgacaatagtgaattactttcttactatagccagaagggctatctattgccataatatcctttaaaaaatctaatatatatttattcatatcaattcctccataggtattataacatattaaattgtatctatttttatacattttaattgacaagtatgttggactttgttattcttgaaaagacaaaatagaaaaattggtagaggtgcatgaatcaagagtaattgttgataatgtttggtgacagtcaacaatgaaagggaaacgtgccgaagaaaataacagcaccaaatgttatttatctgggaaattataaaatatataatttcttgtcactttttagtggagagctatcttgtatgtaaagtactttgatattctcaaggtactttttttatggaggaaaagaatgaattatgtaaagacaatatgggctttattaccgcctgtaatcgcaattatttttgctttaaaaacaaaagaagtttatatttcattactcattggagttgtttcaggaactttattactgacaaattttcatcttgttgaaagtttaaatttattgtttgatacagttgttaattgtttaagtaaaccttctaatattggaattttaatatttttagtaatgttaggaattattgtgactttaatgactaaaagtggaggaagtcaagcttatggaaaatgggctaaaaagaagatgaaatcttctaaacaatctttgttttctacttttattttaggtgttgttatctttgttgatgattactttaactgtttaacagttggaagtgttatgcgtgaaattacagatgaatttaaagtttcaagagcaatgcttgcctatattattgatagtacggcagcacctgtttgtattattgcacctatttcatcatgggctgcagctgtaagtggttatacctcaggggatggttttcaattgtttttaaatacaattccttttaatctttatgctcttttaacaattgtcatggtttgttatgttattggcagtgagtttcattttggaaagatgaaaaaacatgaattagctgctcaaaatggcgatgtttgttttggggatgattcttatcagacaaatgaagaaatttcttataatcaaaaggggaaagttctagatttgattttacctgttattgttttaattatgagttgtattattggaatgatttatactggaggattctttgatggaaaagatttaattactgcttttagtcaatgtgatgcttcgagagggcttgtttatggtacatttgttactttgatctttgtctttattttatatattccaagaaaaattatttcttataatgaatttgtagaatgtattcctgaaggttttaaagcaatggttccgtctattttgattttggttcttgcatggtctttaggagatttagtttctaatcagttacaagcaggagcatttgtttataatacgttacaatctgcttctatttcaacagctattttaccagcatgtttatttattgttggggcaggtctttctttttcaacagggacatcttggggaacttttggtattttgattccgatggcaacttctttatttccagaaggatcaacaatgttggtgatttccattgcttccattcttgcaggtgccgtttgtggtgatcatatttcacctatttcagatacgacaattatggcttctacaggggcaaagtgtaatcatctttatcatgtaaccactcaaattccatatgccttagttgtcgcaagtgcttgttttataggatatcttgttgctggatttacacaaaatgtattattaacattatttgttgcttttgtttcattaagcatcattatttttgtaattcgtctttatcaaaaaaagagttcataaaaacatttgaacatcaaaatatattgtggtatagtgttgcgggtgataaaaatgaaaaagagtaagatatctttaataatgaaaatcattgcagtagtcgcatctctttatggaatgttacaatcattagatcattggatgttttttacgtattttacgaatttatccaatatctttatagatattatgttagtgattttcattatttatgatctaaaaaaagcaaaatatataccacaagggatgtaccttattaaatttatggcaacgatttccattacattaacgttctttgtttatatgttgttacttgcaccaacgaatagtcaaggatttattggtgcctatttaaataatggagcaggaagtttatgtgtacattttattacaccagttcttgctattattgattttctattatttagtgaacactatagaccagatgaaaaacatgtttattattcagtagtaccaccacttgtttatgtaggttatgtgattgttttaggacatgtttttcatataagatggtatggtgatatgttggctccttataattttttaaattatggtgcaccaacaggatggtttggatttgatttatctttattaggttcaaaaacattaggtattggaactttctatatgattgttgttttattaattatttttattggtttaggtactttatttttaaaattaaagagaacaaagaaagatttatattaatctttgttagaataattaaaagattgtaataatttgggattaccccttttattacaatttttttgttatgatacacaggcaaaaatgatattattttagttttttgaaaaaaacaaaagaaaaaattgaattgtgataagatagtaaggatttatagagggggaaatttatggatatcatggttgtctttcaaacaatgttaaaattgtttttattacttattttaggatttgttttatttaaatgtcatatttttgatgaatatacaaataaaaaaatatcagctttaattgtcaatgttgcttcaccaatgttgattattagttctattgcgggggttgaaggaagtaataaaagtattgtctttttaatgataggtgcaggtattttaatgtatatcggttttattattttagggaaaatcattaatcgaatctttccatttcctaaaaaagattggcctgtttatgaatgtatggtcgtttttgcgaatacaggatttatgggatatcctgttttattagatgtttttggacaagaagctgttttctatgcatcacttattcatatggcttttaacttttttgtgtatacatacgctattatgtgtctaacaaaaggagacgatagtgaatttaaattaaattttaaacaattattaacaccaggaattattttgatttttgtaggaatatttatttacttatttgatattcaacttcctagtgtacttatggatacgattaatagtgttggttcacttacagctccactttcaatgatgatgattggttcatcattagctgtttatcctattaaagatagttttacagattggcgtagttatgtctttgcttttgttcgtttaatgattgttccttttgtaacaatgatcatgtgtcgtttattacacattgatgcttattacgctaatattacaattattacaaatgcaatgccagtaggatcaatggttttaatgctggcaacacaatataatgcaaatgtaaaaatcgttacaagaaatattgttgtttcaactttattatcagtgattacaattccaattgttgtcgcaacaatgttattataggagaaaaatatgaattataaaatttatgatcaattgcctcaagaagcaaaaaaaattagaattaaagtttttatggaagaacaaggatttaaagatgaatttgatgatttagatgaagtatgtaaacatcttgttgtttttgatcatcaaaaagcaattggaacgtgtcgctattattatgatgatcctttacaagcaaatgttattggaagaatagcagtgattaaagaatatagaggtaaaaaggtaggacaatatattgttaaaactgcttgttctttaattcaaggaaatgtttgtttacatgcgcaattacaagctaaacctttttatgaaaaattaggatttaaagcttatggtgaaatagattatgatgaagattgtccccatacatggatgaaaaaataaaagagacatcaactttaagattatattcttaagttgatgttttttattttgcatataatttttgtgtgtgaaattgacaaataagagggaaagaagtatattatagatagatgagacatacagtctcaaaaaatggtgcttgtaaatttaaagtaacgattatttattagttttatatgagagttgcggtatcaatatttaatggtgaaggaggaaaaatatgaataagaaactcattacaatgcttgtaacattttgctttatgctactattagcgccagtttcagtaatggcggcaacaccaacgaatgcaccaatcgtcattgatgtaggaggagcaaatgttgaaaacgaaaactataaaattacagatacaggcattaatattcgtaaaagagatgttaattatgaattgacaggtacgactgataaacaaattaatttttggggaagtaataatcctaatgaagttgatcaagctttttatttaaaacttaataatttagtatgtaatgggggctttatggtacaaaatagccctgtgaagatggtagttgaagtgcctaaagatacaaataataaactaaaaagaatttcagctaatgatttaactatatatggatcaggagtattgaatacagaaggttttactgtaacacaaaaaacatcttatatgaatagtgcacttcatgttacggatacaacaatcaatgtaaatgtggcacgaaattcggctgaatggaatggaaaatgtgtgatatcaggaaatgcggttcttacatatacaggaaatggaacatacgcgcctttacaattgggagtaaagaatagggatactactcattcggttttattagaagataacgcgaaacttatttgtttacaagatgaccctgaaacgccatcggaatattctgtttcaggactagaatcatttggtgcatctataactttaaaagataatagttatttagaagcggaagcaaaatcaacaacaggaaaatatgcaggttttggaattatttctctttctcctatgaaagtgcttggaaattctaaagtggtggctagaggctatgatgctgctttaagcgtagatactaatttagaaattaatggtggaactattaaggcaataagtaaagaaagcaacggtatttatgcgaataatttaaaaattgaaaatgcacaaattgaagctgaaggatactatcctgctttatttggaaatgctgctttatctatttcaaatagtaccattaatgcaactagtacaggtgatatcgcaatctttacaagaggtaatctttctatagaaaacagtaaagtagacgctaatgctccacaagatatagaaggaataaaagctagacaaacaacaacaattaatcaatcttggataacaacaacaggaaatgaatcttatgattctattaatgatagtgttcttttcaatggtaataatggtaaagttattggtaatgccactgtaatcggtgaagaaacggtttcatctaaaaaaactttaataataccagaaggaacaacattaacaatccctgataaagctaaatttacgaacaatggtacggttgttgtaaatggcacaattataaataatggacaaattacatgtacaaatcattcgggtggaaaagctacttgcatacaaaaagctgtttgtgaactttgtaatcaagaatatggtgatttattagaacataattattctacaaaatggatgaataatgaagaaattcattggcaagaatgtacagtatgtcataatcataaagatgaatcgaaacatatatttgatgatgataaagatactgtttgtaatgtttgtggatatgaaagaatggtaaatattaaaacgcctaaaattataaaaggtcaaaatagtaaatggaaaaaagatagcaaaatagattttgtatttgtttcagatgcagattattctgattttgtaagtgtatctattgatggtaagataattgattcaaagaattattcatctaaagaaggaagcacgattatcacattaaaaagtgattatttaaatactttatcagttggaaaacatacaataagtattaattcaacaacaggaagtgcatctactgaatttattattgaatcaaatgtggtggaaacacatgtaaaagctgaaaataaacaagaagttaaaaaggtaaatacaggcgataatacaaatattgtaggtattactttattattggtaggaagtttgatagttttaatttatttaaataaaaagaaaacagcttaattaagaagatatcgtcatagtaggcgatatcttttattaggtatattaatagatataaaaaatctttgacaaataaatgatgaagtggtttaatacaaataaatacagtgaaaagaagtagtagatgatcaaaacataagtagagagcttttggttggtgaaaaaaagttatgtttgatgattgaattcctcttggagtagagtattgaagtaagtagatatctccggtaacacccgttaacgtgtatgagtatgtaggtacttagtaaggttattattgtgaaataataacgaagtaaggtggtaacgcgatggtctctttcgtccttatgggatgaagagacttttttattaatatatgggggaaataaaaatggaaaaaagaattacaggacatacagaattattaggacttattgctacaccaattagacattctaaatcaccagtgatgcacaatgctgcttgtcgtgctttaggcttagattatgcatatttagcttttgatattcaaccagatcaattagaagatgcggttaaaggtttcaaagctttaaatgtaagaggatggaatgtttcaatgccttataaaacaacaattggtcaatatttagatcatattacaccaattgctaaaatgtgtggcgctattaatactgttattaatgatcatggtgttttaactggaactattacagatggaacaggttatatgacagctttaaaagatcaaggaattgatattattggtaaaaagatgacaattgttggtgctggtggagcagctactgcaatcgtcatgcaagctgcattagatggtgttaaagaaatcagtattttcaatattaaagatgcttcatgggatcgtgctttagaaaatgtagaaaaaatcaattcacaaactcaatgtaaagcacaattatttgatttaaatgatcatgaaacattaagaaaagaaatcaatgagtcagttatttttacaaatgcaacaaatgtaggaatgggtaaattagaaggacaaatggttttaccagatacttcttatttaagaaaagatttaattgtttcagatgttatttatatgccagaaaaaacaaaattattagaagaagctgaaaaaataggatgtaaaacaattaatggtttaggaatgatgctttatcaaggagctgcttcatttaaattatggacagatcaagatatgccaattgatgttgtaaaagaagctttagacttttaaaatgttatgcagtgcatagcatttttttatttgacaaatagaatattttattatactgttgatatatcaactaatggaggcatactatgattaaaattgttgcagaaaattatattaaagaagaatatcaagaagaatttttaaaacttacaaaagaacttattattttaagtagagaagaaaaaggaaatatctcttatcatctttatcaagatattaatgatgatagtcattttacttttattgaagaatggcaaaaccaagaagcaattgatgaacataatcaaacaaaacactttacaacaattgttcctcaaatcaaaagctttgcttcaaaaccttcaagagcaattaaatataaagaggtgcaataatgaatacgttagaaacaatttttacaagaaaaagtgttcgacaatttaaaaatcaaaaagtagatgaaaaagacatcaaaacaatcttaaaagcaggaatgtcaggaccaacatgtgttaattcaaaagattggtcatttatcgttgttggcgatccagaagttcttcataaaatgtatgaagcaaatggtgtaccagcgaaaccattacttgaatgtgcttttgctattttaatttgtggagattatacaaaggcatttcaatacgctaaagattattttgctgtagatggttctattgctggacaaaatatgattttagcagcttggtctttaggtattggaagtgtttggcttggtacatggccacaaatggatcgtgtttttgcccaaagtaaattgtttgatttaccaaatgatcaaattcctcattcaattattgcttttggttatcctctagatgaaattaaagagaaagaagaatattatgatgaatctgttgttcattataataagtggtaaaaatggttaaagaaattattaaagatgaattctttttaaaacaaaaatcaaagtcatgtacaaaagaggatctatatatcgccaatgaattattagaaacaattcaagcttacaaagaacaatgtgttggtatggcagcgaatatgattggatatttaaaaacaatgatggttgttttagatcaaaataaatatcttattttaattaatcctgttattttaaaaataaatggaaaaacgtatcaaacagaagaaggttgtctatcattacaaggtgtaagaaagacacaaagatatgaaagtatcaaagtaagttatttagatcaaaattttaaaaagaaaattagaacgtttaaagggtatacagctcaaatcattcaacatgagcttgatcattttgaaggaaaaatcatataaaaaatcagcaatagctgattttttaatgacatatttcttcaacaagttgattaattgcctcttgattttcatctttataagtagatttaattgtgaccgtattttcacaaatagtaacatttttcattggagtaagcatttctttcatcactttatttgcaagaggagcccaagaaccattttcaataagtccaacagttttattttgatatcctttatgttgtaatctatgtaagaaatcttccattggactaaagacaccaccatcataagtagctccagctaaaatcattttagaatatctaaaagcatcttcaactgcttcagccatgtcatctcttgtaagatcagtgaaggcaactttaacacctttttcttttaataaatcaactacttttaaagccacttctttggtatttccatggatagaagcactggccactaaaaccccttcatcttcactttgataactactccaaatttggtatttatcaatataatatcctaaattatcttttaaaataggaccatgtaaaggacaaatcattttaatatctaaagtgctggctttttttaataaagtttgtacaggagcaccatatttaccaacaatattaaaataataacgtcttgcttcacaagcccaatcttcatcatgtgataaagccccaaatttaccaaagccgtctgctgaaaataacactttttcagttgtttcatattctaccatgacttctggccaatgaaccattggcgccatgatgaattttaaatgatgatttcctaaatctaattcttctccttctttaaccacaatacatctttcatctaatccttcaatattaaaaaattgaggaagcatcgcttttgctttggcacttaaaacaagttttgcttctttatacttttctgtaaataattgaatatttgcggaatgatcaggctctaaatgagaaacaatcaaataatcaggaacacgttcctttaattccttatctaaattatcaaaccattcttttgtctttcttgcgtcaactgtatccataactgcaatcttttcatctaaaataagataagagttatagcttacaccatgagggacaatatattgactttcaaaaagatctaatgttgtatcatctacaccaatatatttaatagattcacttattgttatattattcataaaaatcctccttttttatgtattatatcactaatataaaggaacaagatataaattattgattatgttaatttttttgtcatatcaattcttacaaatgtaatttgaaattataatgatataataaaaataaatatatatttagatgtttggaggataagtatgaaaaatatatttgaaatatctccgaaagccattataaatttgaatggaagaaattaggaaatattaaaaaatgaagagaacattcaggagaagaaatgcctgtacttgtttatcgattgttagaatatagtatgaatgatgttttatttaagaattttggtattgaaaaaacagatgaaatctttagacaagctggatatcttgcaaaatgtgaatttgcgaaaaatgctttacctcttgatattgatgaaagtacatttattagtacgcttgtgcaaacattagaaacattaaaagtcggtattttgagactggaaaacttagtactttagaaacacttttaaaagtaaaactaggaagtttatcaaaaaatctagaagaacaattatcaaataaaatcattgaacaattagacgagttaacagttaatatttttaatattaatagtgaagaagatgttatgaaattacttcattaaaagggaaatcatatttctctttttttataataaattttattttttagcactttagtgttgacagtgctaaaaatatgaatataatgaaattagcactagggatagaggagtgctaaaggagagtgataacatggatatcgaaaaatttacagccaaaatgcaagaggctattcaaaaagcaagtcaattagcattaagttataagcatcaagtaattgacattgaacatgtattgtatgttttattgaatgatagtagtggtatttttccaagggtgttatctaagctaaataaagataaaaatcattttattcaagtattagaacaaaggcttcaacaaaaaacgacacttgaaaatattgatgtcaatagtatgagaataagctatagcttaaatgatttacttgcaaaagcaaatagtcaaatgacatcgtttaaagatgaatatatgtctgtagaacatgtcattatggctttatttgaaataaatgaaaattgggtcaaagatttattgaaccaagaaggtatgaataaaaaggatacaaaaaaggtaattttagaaatgcggggtgatcatatggtagacaatccaaatccagaaaatacttatgaagtattagaaaaatatggacgtgacttaacaaaagatgtggaaaatggaaaattagatccagttattggacgtgatgatgaaattcgtcgtgtaattcaaatcttgtcacgtaaaacaaaaaataatccaattttaattggtgaaccaggtgttggtaaaacagccatcgttgaaggattggcatggcgtatttataaaaatgatgtaccaatttctttacaaaataaaacattatatgaacttgatttaggttcacttgtagctggtgctaaataccgtggtgaatttgaagaaagattgaaagcagttttaggtgaaattaagaaagctaatggtaatattatcttatttattgatgaaattcatcaattagttggtgctggtaaaacagatggtgcgatggatgctgctaacttattaaaaccaatgttggctcgtggtgaacttcattgtattggagcaacaaccctagatgaatatagacaatatattgaaaaagatgcggctcttgaaagacgtttccaaaaggtacaagttgatgaaccaacaattgatgatagtattgctatcttacgtggtttaaaagattcttttgaaagacatcatggggttaaaatcaatgatagtgctattattggtgctgttaatttatcacaaagatatattactgatcgtttcttaccagataaagcaattgatttaattgatgaagcgtgtgcttctattcgtatggaaattgattctttaccagaagaattagatggtattacacgtgaaaagaatcgattagaaatggaaagaatttcgattgaaaaagaagatagtaatgaagataatgtaaaacgtttaaatgatattaaagaacgtattgcttctttaactgaacaagaaacagcattaaaagcaaaatggaaagaagaaaagtcttcattagatcatattaaagaattaaagaatcaaaaaaataaacttgtagctttacaagataaatatatgcaagaaggtaatttacaagaagcttctaaacttcaatatggtgatattccaaaaatcaccaaagaaattgctgatcttgaagcaaaagaatcggatgatgctttacttcaagaaaaagtaactgttgataatgtctcagaagttatttcaagatggacaggtattccaatgaataaattaatggcttctgaaagagaaaaacttttagccttagatgatacattaaaagtacgtgttattggtcaagatgatgcaatcactaaagtaacagatgctatcttacgtagccgtgctggtatcaatgatgaagaaaaaccaattggatcattcctattcttaggtcctactggtgttggtaaaacagaagtggctaaagctttagcagaacaattatttgatactgaaaagaatattgtgcgtattgatatgtctgaatatatggaaaaatttagtgtttcacgtttagtaggggctccaccaggatatgttggttatgaagaaggtggacaattaacagaagcagtaagacgtcatccttatagtattgtattattagatgaaattgaaaaagctcatcctgatgttttcaatattttacttcaagttttagatgatggacgtattacagatagtaaaggaaatacagtaagctttaaaaatacaattattattatgacaagtaatattggttctcaatatttattagaaggtaataatgaagaaaatagaaaacttgtaaaagaagaattaaaagtgcactttaaaccagaatttttaaatcgtattgatgaaattgttatgtttaattcattagatagttcagtagtaagaaaaattattgataaatttattggtcaattagttcatcgtttacaagataaaaagattacgatttctttaactgatcaagcttatcaaatgattcaagaagaaggatttgatccaatctatggagcaagaccattaaagagatttattcaatctcaaattgaaaccaaacttgctaaagaaattattaaaggaacagttcatcaaggacaacatgtagaagttgattatcaagatgaatttgttttaaaagctcaataaggaagtagtataaaagctacttctttttttataaaactattttgtatttagaaagaaaataatagctaattaagtacgagaaatcgtacttttctttttgaaattgtaggaatataaataaaaatgtaaaattgttttttcttggggaaatattatgctagaatatgttggggtgaaagacgatgcaaaaatattttataaatgaaaatatcgaattaaataaatctttcaaaatagaaagtagtgatcaacatcatatagaaaaagtaatgcgtaataaaaatggtgatcaaattatttgtgtagacttaaaacatattcaatatttatgtttaattgaaaatgttcaagaaggtacaattttaccaattgaaaaattagatattaataatgaattagatgtagaagttacacttgtttatgctttacctaaaggagataaatttgaatttgttttacaaaaagcttgtgagttaggagttcatcatattattccattaagttctaaaagatgtgttgttaaacttactaaagacaaattcaataaaaaactgccccgctatcaaaaaatattaaaagaagcaagtgaacaatcaggaagaaatagaataccttcaatagaagaagtaaaaacaattaaagaattaaaaccctatttaaaagattataatttagtggcttatgaagaaactgctaaacaacatgaacatggtgaattatttcatactttacaacaattaaaagcaggagatcaattattgattattgttggttgtgaaggtggctttgatgaaagtgaaattcaagaattaaatgagatgggtgttaaatgttgttcattaggtaaccgtattttaagaagtgaaacagcaccactttatttaatgagcgtcattggttattcaagggagcttacaaaatgattaaattattaaagaaatatggggtagagttaaaattaaaaaaatgtgatttgtttcgtcttattgaaggacaaaaagatacttttcttgaagatggttttgcttttaaaatgacaaatgaagaagaaatgtttaaatatgaagtgattttaaatggtatttataataagacaaaaatagaaggggaatataagaaatttgtttatgagacacaagatgctattcaatatttaaattatgaagaaaaacaaaaaatgtttaatagtattattagtgaaacgttaaaaaatttaaaactcatgaaagttggtcaacaaattattttaattccttatttagaaccttttataaatgaaagatatttaaataattatatgttattaacattaaaacaacatcaattgtatgttaaaaattatcaaagaaatatagaaattccttatcaactttatggtttaaaagtattacgttctgctttttcttctttaaaagggatagctgaagatgaaaattatgaatattattattatgatggtttaaagaaaatctatatttttgataagaaagaatatggtttagtagatagttttccaatagttgataaatatttccaaggaaatacatctttagatgatataagagaagttatgacttattataaacaacctcaacaatttataaatcaattacatgaattaaattatttaagtgataaagtacataaaaaaattatgaaaaaattaaagtaggtgaaagaatgaaagttgcattccatacattaggatgtaaagttaattcctatgaatctcaagcaatgttaaatatgtttgaagaagcaggatatgaagaagttgattttaaagaagtggcagatgtttatgttgttaatacatgtactgtcacaaatacaggagatagtaaatctcgtcaaatgatacgcaaagcaattcgtaaaaatcctcaagcaaccgtttgtgttgttggatgttatagtcaagtagcacctcaagatattgaagcaattgaaggtgtaagtatcattttagggacacaatttagaaatgaaattgttgatttagtagaaaagtatcaacaaacacatgaaagaattgtgaaagtttctgaagttaaacaattaagaaaatttgaagatttaaatattgatcgttttttacatacaagagcttatttaaagattcaagatggatgtaataatttttgtacatactgtattattccttatgctagaggaagagtgcgatctagaaaaccagaaagtgttattaaacaagcaaaggaattagtagctaaaggatatgtagaaattgttttaacagggattcatacagcaggatatggtgaagatttagaaaattatagtttttatgatttattagtagatttaacaaaaatagaaggattaaagagacttcgtatttcttctattgaaacaagtcaaattactgatgatattattgatttaatttcaaaatctaaaattattgtggatcatttacatgtaccgcttcaagctgggtgcgatgaaacacttaaacgtatgaatagaaaatataattgtgaacaatattatgaaaaattatcaaaaattagaagattgattcctgatattgtttttacaacagatgtcattgttggttttcctggagaaagcgaagaagagtttgaaaaaacttatgaatttattaaaaaagtaggatatacacaacttcatgttttcccttattctatgcgtaaaggaacacctgcagctcgcatggtacaagttgatgaaaaaattaaacatgaaagagttaatcgtttgattgcactttctcatgaattaaatgaaaattatgcaaaatctcaaattggtaaaactttaagagttctttttgaaaaagaagatcatggatattatgtgggacatggagataattatttacttataaaagtacaaagtgatgaacaattgataggacaattgaagaatgttataattaattcatatgatgaaatgttaattggaagagtggtataatgaaacgattaaatgagttgtttgatattgataatgatatgaaaatatactcaattcatagtgattcaagatatgtaaaaccctattctatattcttttgtattgaaggattgagtgtagatggacatcgatatgtagatgatgccatttttcaaggagcaaaagttattgttcatagcaaggatatagaaaaacaaccaggcattatttatattaaggtagcagatgctttagatgaattaaatagagtttctaatgtattctatgattatccaagtaagaaaatgcgtgttgttggagtgactggaacaagtggtaaaacagttgttgcttcaatggttaaaagtgtaatggatcattattgtaaagcagcttacatgggaacaatttctttagagtatgatggggtagaagaacagtgcccttatacgacaccagaaactttatatgtacaaaagaaattgtttgatatggcaagacgtggtgttaaggttgttgccatggaagcaagtagtcatggtttggcacttaaaagaattgatgcagtcgattttaatattgctgttttaacaaatatttctgatgaacatttagattttcatggaactagaagacaatatattgaaagtaagaaaaaattattttcaatgttatctacaaattcgattgctgttttaaataaagatgaagaagtttttgctgaatttaaagcagctacgaaagcaagaattatgacttatggtattaaaaatgaaagtgaaattatggctaaaaatatagaactttatattgatcatagtgaatttgatctttcattaaaagggaatctatatcatattgtttgtccaacaattgctgattttaatatttataatgttctagcaacggtaggagtacttgttggtttaggatttgatgatcgtatgatcattgaagccattagtgatttaaaaccagttaatggaagaatggagcttattcctaataaacataaaattacgattattgtcgattattgttgtcatacaaaagattttgaaaatgtttttaaatttgcagatcgtgtttctagaggaaatattattgctgttttaggagcaccaagtaaaagacatatggcaagaagaaagaaaataggatcattggccaatagatatttagatcatgtgattttgactgaattagatgatcgaggagaaaatattgaggaaatttgtaaagaaatccaaagtgaaattacagatattccaagcattattattcctaatcgtgcagtggctgtagaacaagctattgaacaggcaagtccaggagatgttgttttattattaggaaaaggtcatgaaaaatttattgccttagaagttggtcaaagagagtatgaaggagataaagcgatagcattaaaagctattaaaagagtatacgaaggagaagaagaaaatgaactacaacaaaatgattgatcatactgttttaaaagcagatacacctttagaaacagttaaaagaatttgtgatgaagcaatggaatatggttttgcaagtgtttgtattaatccatgccatgttgcttattgtgcagactatctaaaagatagtaatgtcaacgtatgtacagttattggttttccattaggagctaatacaagtgcagtgaaagcttttgaaacaaaagatgcgattgctaatggggctgatgaaattgatatggtaatgaatatcggagctttaaaagataaaaattatgatttagtaagagatgatgttaaagcggtagttgaagctgctaatggaacattagtaaaagttattttagaaacttgtttacttacagaagatgaaattaaaaaagcatgtgaattatgcgtagaagcaaaagctgattatgtaaaaacaagtactggtttttcaacaagaggggctacaattgaagatgttagaatcatgaaagaagctgttcatggaaaagcaaaagtaaaagctgcaggtggtgttagaacacctgaagatatggtgaaaatcgttgctgctggagctgatcgtattggaacaagtgcaggatgttctttagttaaaaaataagttggatgtaattttaattttttaatgttatttacaaaatataggtataaaatgaaaaatatgtaaatggtattcgaaatgaatatcatttacttttttattccaaaaataatatataactaaagaagaaatgagggattatatgggaaatacaccaaagaaaataaaagtaagaggtgcaaaagtacataacttaaaaaatatcaatgttgatataccattaaatcaaatagttgctattacaggtgtttcagggtcaggaaaatcatcactagccatgggtgttctttatagtgagggttcaagaagatacttagaatctttatcaacttatacaagaaggcgtatgacgagtgctacgaaggcacaagtagatgaagttctttatgttcctgcggctttagcacttcaccaacgaccagctgttccaggtattcgtagtacgtttggaacagggacagaacttttaaatagtttaagactcatgtattcacgtcttgctaagcattgttgtaaaaatggtcattatattgaaccaactttaaatgtggcggctgaaaaagaaatcatctgtccaatttgtaaagaaaaaatacatgcaccaagtgctgaagagttagcttttaatagtcaaggagcttgtcttaaatgtggtggaacaggaattgttagaactgttgatattgattcgcttgttcctgataaaacacttaccatagatgaaggagcagtcgttccatggaactcattaatgtggactttgatgacagatgtttgtcgtgctatgggagtaagaacagatgtgccttttaatcaattaactgatgaagaaaaaaatattgtttattatggaccggcggaaaagaaacatattttttataaggctaaaaatacagatcatgcaggagaaatggattttacttattttaatgcaacttatacagtagaaaatgctttatcaaaagttaaagatgataaaggaatgaaaagagttgaaaagtttttaaaagaagaaatttgtccagaatgtcagggaacacgtttatcaaaagaagcaagaaaacctttgattagaggaattggtttagataaagcttgtcaaatgccattaaatgatttagtagaatgggtaagaggtattccagattcaatgcctgatgaaatgaagccaatggctcgtgaaatctgtgattcgtttttagatgtttctaaaaggctgttagatttaggattgggctatctttctttagatagagctgcttctacactttcaacaggagaaagacaacgtatgcaacttgctagagcagtaagaaatcgtacaacaggtattctctatgttttagatgaaccttctattggattacatccttctaatatttatggacttataggagtcatgaatgatttaattcatgatggaaattctattttattagtagatcatgatactgaaattattaaagaagcgaattggctcattgaaatgggaccagaagcaggaaaaaatggaggttatgtttttacggaaggaacaatagaacaaattaaaaatgataaaaagtcaatgattgggccattccttacaaatcattatgatgaaaaaatgcgtccaatatctccaattgaacaactatttgaatttggaaaaattcatctttcaacaaatcaaatacatacagtccatcctttagaagtagatattcctaaaggaaaattaacggttgttacaggagtgtcaggttctggaaaaacaacgatgattctagaaagcttgttaccagcgattcaaactaaaatcaatgactcatcattacctgatcatattaaagatgttcaaatggaaggaatagaacatattaaactgattgatgcttcacctattggtattaatattcgttcgactgttgctacttatattaatgttcatgatgaacttagaaaaagatttgccaaaacagaaagcgctaagtctaaggggtataaagcaggagatttttcttataatacaggaaagcttagatgtccaacttgtgatggaacagggacattaagtttggatgtacaattcttgccagatgttcatgtgacttgtcctgattgtcatggttctagatataataaagaaagttattttattaaatataaaacgtcaaaagagaaagagtattctttacctgaattgatggaaatggatgtgagttttgctaaagaagcttgtcaagatttaaaaggtgtttatcgaaaactggaagtattagaaaacttaggtttaggatatttgacattgggtgaggaaacaccaagtttatctggtggagaggcacaacgtttaaaacttgcaagtgaaatgagtaagtctcaaaatgattcaatttttatctttgatgaacctacgattggattacatcctttagatgttcaaatattagttaaagtttttcaatcacttgtagatcaaggtgcgacagtcgtcgtcattgaacatgatcgtgatgtgatgaaaaatgcggattatataattgatatggggccaggtggtggtcgagatggtggaatgattgtagctactggtagtgttgaagaaataaaaaataatataaagagtattacaggtaaatatttataaaaaaatagaagttcaatgtgaacttctatttttgtcttgctgaaacaataaagtgtaatgcaaaataagccacttcatcttcagtaaatcttttatgataaatagattcaatagcgtcatttaagatttctgccattgcaaattctttaggatgtctttctttaatctttgcagttaaaggattttcgatttgactatcatctaataatcgatcaagtgcaggtgttaaatgtaatcctaaagaaacaagtaatttttcattatttcttaaatctatacctttttgtttaaataaagaatctaaagtgttttgtagaacatcaataatttcatcatctaataaattaacaccagcattaaattcaacatctaatacgttatttttagataggtacattgaaataagtgctaattctgattctggaaattcaatatcaaattttttactaagaatattacaaatttcaactgctgaatcatagttagtatttgctttatatgatgtgatttgtccttgacttaaaggaatgtaattgtttgttttgattctaagcattgcaattgcaagatgtacaacgagattttgcgtaaattgtggagataatgttaaatgatttttctcaattacttcatttactgcttcgcgacatacttgttttgataattctaaatctttatcagcagcgcttgataaagcttggtttgttaatgtcataaaaaagcctcctaaaatgtctacgtaaactatatactaaatcaattagaaaagctaggaaaaaataaatattctttataagagcatatgattggattttaggaatgattcctgttatactaaacttgtaaaataattatgtaagcgctcatcattttctttaagtttttgttgtctatgcaaaatgtaagtgctataattatgaaggaattttgatttaggaggaaataaacaaaatggctgtaacagataaattcaatgaagaatggaatggatttaaaggaagactttggaaagaagaagtaaacactcgtcaattcattcaagataactataaaccttatgatggagatgaatcatttttagctgatcctacagaagctactaacaaactttggggaaaacttcaaaagttacaaaaagaagaaagagctaaaggtggagtattagaatgtgaaactaaagtagtaagtggacttactgcttatggtcctggatatatcgatgaagaaatgaaagatttagaaaaagttgttggtttacaaactgacaaacctttaaaaagagctttcatgccttatggtggtatcaaaatggcagaacaagctgctgcaacttatggatatgaaccagatgaaaaattacatgaaattttcacaaaatatcataaaacacataaccaagcagtattcgatgtttatacaccagaaattaaaaaagctcgtcataataaagtaattacaggtttacctgatacatacggacgtggacgtattgttggtgactatcgtcgtgttgctttatatggtattgatttcttaattgaacaaaaagtaaatgatttcaatcattgtggtagtggatcaatgactgaagacattattcgtaaaagagaagaaattgctgaacaagtaaaagcattaaaaggtatgaaagaaatggctgctatctacggatatgacatttctaaaccagctaaaaatgctcatgaagcattccaatggttatactttggatatttagctgcaatcaaaactcaaaatggtgctgcaatgtcagttggacgtatttctactttcttagatatctatgtagaaagagatttagctaacggaacattaacagaagaagaagcacaagaattagtagaccatttcgttatgaaatgtagaatggttaaatttgctcgtattccttcttacaaccaattattctctggtgacccagtatgggctacacttgaagttgcaggtttaggaactgatggacgttcaatggttactaaaaactgtttccgtttcttacacacattagaaaatatgggtccttcaccagaaccaaacttaactgtattatatacaaaagcattaccagaaaacttcaaacgttttgctgctaaaatctcagtagatactagctcaatccaatatgaaaatgatgatgtaatgcgtcctgtatggggagatgattactcaatttgttgttgtgtatcagctactcaaactggtaaagaaatgcaattctttggtgcacgtgctaacttagcaaaatgtttaacatatgctatcaatggtggtattgatgaaaaaactaaagatcaagtggctccaaaatatcgtccaattacttctgaatacttagactatgatgaagttatggaacgttatgaccaaatgatggaatggttagcagatctttatgttaatacattaaacttaattcaatatatgcatgataaatattattatgaagctgcacaaatgtcattaattgatactgatctaaaacgtactttcgcaactggtatcgctggattctcacatgtagtagattcattaagcgcaatcaaatatgctaaagttaaaactattagagatgaagatggtgttgttgtagattacgaagttgaaggagatttcccaagatatggtaacgatgatgatcgtgctgatgatatcgctgtatggttattaggtgaattcttagctaaaatcaaaaaacatcatacttacagagattcagaaccaacaacttctatcttaacaattacttcaaacgttgtttatggtaaagctacaggttcattacctgatggacgtaaagcaggtgaaccattatcaccaggtgctaacccatcttatggtgcagaacaaaatggtttattagcttcattaaactcagttgctaaattaccatatgaatgggcattagatggtatttctaatactcaaacaatcaacccagatgctttaggacatgatgaaggtgaaagagttaataacttagtacaagttatggatggatattttgaacaaggtgctcatcacttaaatgttaacgtatttggaactgaaaaattaattgatgctatggaacatccagaaaaagaagaatatgcaaacttcacaattcgtgtatctggatatgctgttaaattcattgacttaactcgtgaacaacaattagacgttatcgcaagaacttgtcatgaacatatgtaatcaataacttaatcaaataatgaaaacaacctcttatgaggttgttttgttacggaggaaaaatggaaacaattggtagaattcattcaatagaaagctttggatcagtcgatggtccaggagtacgttatatttatttcttacatggatgtcctttaagatgtcaattttgtcataatcctgatacatggggttcaaagaaatacgaagaatatactcctgaaaaagcgcttcaacaagcaatgaaatacaaaacatattggggtaaaaatgggggcattacgattagtggtggagagcctttagctcaaatcgattttgttttagagttatttaaacttgctaaaaaagaaggaattaatacgtgtattgataccagtggaggatgtttcacgagagaagaacctttcttttctaagtttaatgaacttatggagtatacagatttattacttgtagatattaaagaaattaataatgaaagacatcagcttttaacaggaagaagtaatgaaaatattcttgatatggcaagatatttatctgaaattgataaaccaatttggattagacatgttcttgttcctgaaagaagtgactatgatgaagatttaattgaattagatcattttatttctacactttcaaatgtttatcgtgttgaaattcttccttatcatactttaggtgtatttaaatgggaggaattgaatattccatatcaattagaaggaattaaacctccagttaaagaacgtgtagaaaatgcaaaaagattattacatgtagatcgttatacacgttatttagataattaatgaaaaaagagttcatgaatttagatttatcggcgctctaaataatcgagtgctttagcgaaattcgctctaaattattaagggggggaggatataaaaatgagtaaaaaacctgtaaaaattgtaacaattggtggaggaagtagttatacaccagagttaatggaaggatttattaaaagatatgatgaacttccaatcaaggaaatttggcttgtcgatattgaagatgggaaagaaaaattagaaatcgttggtaaaatggcacaacgtatgtgggatgcttctccttatgatgttaaagttcatttaacattagatcgtagagaagcattaaaagatgctgatttcgttacaactcaatttagagttggtttattaaatgctcgtattaaagacgaaagaattccatttagctatggtatgttaggtcaagaaacaaatggtgctggaggtatgtttaaagctttaagaacgattccagttattttatcaatcgttgaagatatgaaagaattatgcccagatgcttggcttgttaactttacaaatccatcaggaatggttacagaagctgtcatgagatttggtaaatgggataaagtcattggtttatgtaatgttcctgttggagcaatgttagatgaaccaaaaacaattggtaaaactttagatcaattaacttataaatttgctggattaaaccatttccattggcataaagtatatgatgaaaatggtaaagaagtgactaaagatatcattgaagcaatgtatgaaggaaaagatatgggaattcctgcaaacattcatgatattccattctttaaagaacaattacttcaaatgaatatgatcccatgcggatatcatagatattattatcgtgaagaagaaatgttggctcatggtttagaagaatataatgatcctaaggtaggaactcgtggacaacaagtacaacaaacagaacatgagttatttgaattatataaaaatccagatttagatcataaaccagaacaattagcaaaacgtggaggagcacattattcagatgcggcttgtgaaacaattgcttcaatctatggaaataaattatcacatatcgtagtaacaactaaaaataatggatctgtcccagatttaccagctgactgtgcagtagaagtttcatcttatattggttcaacaggagcaagagctattgcctttgggtcattacaaccagctcaaagaggatggttacaatgcatgaaaaacatggaattatgtgttgaagaggcagctgtaacaggagattatggattattaatgcaagcattcattttaaatccacaaacagtatcaggacaaaaaatggtcaatgttttaaatgaattattgattgctcatgaaaaataggactgaaaatcctcgtgtcggtggttcgattccgcccggaaccaccattttttttatctttaaaggagaaaagttatgtttaaatataaagatttaagaatggtcgctatttcaattattttggttattttatgtgtgtttagtggaattcattttcgttatgatcgaatgaaattagtggttgttttattactagcgttaggggtacttcctactttattaatacgttttaacgcttctgtttttgaagatggtttattagtatatttctttaaggggatcggttttatgcctcaaatgattgaatttaaggatttaacagcatattcacttaattcaaaacatcgaattgaattacaatttaataatcatacaaaaaatatttatttagtaaacgctacatcattttatgaagaattagataaaaaatttaatcaatataaaaatggacaagagatttaatctcctgtccattctttttgtttattaatagattccttgagaaatcatagcttctactactttttcaaaaccagcaatattagcacctttgattaagtcaaatcctaatccatatttttcagcagcagcaacagagttgttgaaaattgatttcatgatattatgcaatttttcatcaacttcttcacttgtccagttatatctcatagagttttgagacatttctaatgctgaaacagcaacaccaccagcgttagcggcttttgcaggtcctaaagtaccaccatttgctgtaaagtaagcaattgcttcaggtgtacttggcatgttagcaccttcgatgatgtatttacatccattagcgatcaattgtttagcttcttcttcaccaatttcattttgagtagcacaagggaaagccatatccacttttaatccccatggtttttcaccaggatggaattcacatccgaatttttcagcatagtcttttaatttaacatcatttgatgaacgaatttttaataagaaatcaattttttcatcagtattgattccatcaggatcataaacgtatccatctctaccagaaatagaaacaacttttgctccatattctttagctttgatacatacaccccaagcaacgttaccatatccagaaacagcaattgtttttccttcataagtatcgttgaaatgagctaatacttctttgccatagtatacagcaccaaacccagtagcttctggtctaattaatgaaccaccataagtcattcctttaccagttaaaacaccgttttcataagcatctttaatacgtttgtattgtccaaataaatatccgatttctctaccaccaacaccgatatctccagcaggtacgtcaacgctaggtccaatgtgacgatataattcagtcatgaatgattgacagaatctcataacttcagcatctgatttaccttgtggatcgaaatcagagccacctttaccaccaccaataggaagtgttgttaatgagtttttgaaaatttgttcgaatcctaagaatttaataattccaaggttaacagaagggtggaatcttaaaccacctttataaggtccaatagcactagagaattgaatacgatatcctctgtttacttgaactttaccttgatcatccatccaaggtactttaaacattaaagttctttctggttcagttaatctttctaaaatagccatatcttcatactcaggatgagctttgattactggttctaagctttctaatacttcttcaacagcttggataaattcaggttgatcagtatttttagcttttaagtttgttaatactctttcaatatattccattgttatatcctcctagggctatcatacatctttaataataataaatgaataaattaagaaaaagttatcatataaataagttatcgtgataataaaaatactacacaacgtgttttatcacgataaaaattgtatacaatcaattatcaaaaaattaaaaattacaacttatgatttgcatacaataaagtatttaaagtataaaatatttcataaaaatacataatcatcttttctttgtatacaatctatgctagaataaagcacaacaagaggtgattactatgaaaatactaaataacacacaattacatcaccatcattggaaaaagtagggttatatcatttatgatacagcccattttgtctatcacaattaagctgtatctaatgatgttgaaacgagtcattagatgactcgtttttttaataaagggggatttttatggaagagtttaaatatttaatacctgaagagagtatagatgcaattattaccaatgttgaaaaattaagggaaattgaaaatcatttacgacatgttttttcaaattatggatacaatgaagtattaatgccgtcatttgaatatgttgatttatatacaaaactagattgtggttttactgttgataagatgtttcaatatatcaatcacgaaggtaaaaacgttgccatgcgtttagatttcacaataccactagctagattatatgccaatagtgccaatacaggtgaagcacgctatagttattttggaaaagtttatcgtaaagaaacaatgcataaaggaagaagtagtgagtttttccaaggtggtgtagagttaatgaataaacctgggcttcaaggagataaggaagtcatgacaatgattcaagaatcattaccaggaatttctttaaaaaatattcttttggaattaggttctgctaaattctataatcgtttattagaattagttggaaaccaaagaaatgaacttgaagatattttaagattaagagatatgagtgaaatgaaacgttttatttcaaaaaatgattttgaagaaagcttaaatcaattgctgttatctttaccaacatgctttggaaatattgatttacttcatcaaatgatggataaatgtcaagattctgttttgttaggggcattacaagaattaaaagatctttatgaatcattagatagtaaagaaggaattatttttgatttaggaatggttccaaccatgaaatattatacaggctttatgattaaaggatatagtgatcaaagtgcaaatccgattttatcaggaggacgttatgatgatttgcttcctagatttaatgttgataaaacagctgttgggttctgctttcatatgaatcatattttaaaagccattgaaaaagagggagagtaacatgattaaaatagctattactaaaggaagaatcgaaaaacaagtatgtaaactgcttgcagaagcaggttttgatatggatcctatttttaataaagatcgagaattattaattgaaacaaaagatggaatttcaatgatttttggtaaacccaatgacgttgttacatttttggaacatgggattgttgatattggttttgtaggaaaggatacgttggatgatgtagattttgaagattactatgaacttctagatttggaaataggaaaatgttatttcgcagtagctgcttatccagaatatcgaaataaagtatttaatcgtcgtaaaaagattgctagcaaatatacaaatgttgcgaagaaatattttgcttctaaacaagaagatgtggaaattattaaattagaagggtcagttgaacttggaccagtgacaggtatttctgatgccattgttgatcttgtggaaacaggttcaactcttaaagcaaatggtctagaagtaattgaaaaagtaagcgatatttcaacaagaatgattgttaataaggtagcttttaaatttaagaaggatgaaattatgaatattgtaaatcaattagaaaaagtaatagggggaaattaagatgcttaaagtaattgagtatgatgggaatttaaaaggaattgcacaaaaattaaataatcgaaaagaagaaatttcgatagaagttaataatgctgtaaatgatattattaatgatattagaaaaaatggaaatcaagccttgatcaactattgtcgaaaatttgatggttatcaaattaaagatgaaaatgatttcgttgtttcaaatcaagaaaaagaagaagctttaaaacaagtggatcaagattacataagaatccttgaaagaacaaaacaacaaattacagaattccataaaaatcaaattgataaatcatggtcattatataaagataacggagtgatcatgggacaaatggcaagaccaattgaaagagttgctttatatgttccaggtggaacagctgcttatccttcaacagttttaatgaatgccattcctgcaaaactggctggagttaaagatttagtcattattacaccggttaaagcagatggcaaagttaatcctgtaattatcgcagctgctaaagtatcaggagtagatactatttataaatttgggggagcacaaggggttgctgctatcgctaatggaacagaaacaattgaaaaagtagataaaatcgtaggaccaggaaatatctttgttgcgacagctaaaaaattaagctatggggttgtcgatattgatatggtggcaggtccaagcgaagttttagttattgctgatgaaaatgcaaatcctaaatatattgctgctgatttaatgtcacaagcagaacatgataaacttgctagtgcaatgcttgtaacaacaagtaaagaacttgttgaaaaagtcaatgttgaactcaaaagacaaatggcttatttatcacgtaaagaaattattgaagaatctcttcaaaattatggaggagcaattcttgtaaaagacttaaaagaagcttttgaagtatctaattatttagcgccagaacatttagaagttttagttgaaaacccagtcaatacacttccttatattaaaaatgcaggttctattttccttggagaatattcaccagaacctctaggtgattatatgtcaggaacaaaccatgttttaccaacaggaggaacagctaaattctattcagcgctaggtgtttatgatttcgttaaatattcatcttatagttattatcccaaaggtgttttagaaacatttaaagatgatgttcaaactttcgcaaaaagtgaaggtttagatgctcatgcaaatagtattgctgtacgttttgaggaggaataatcatgagagaagctaaactagaaagaaatacaaatgaaacacaaattagtttagaaattaatttagatggtacagggaaagcagagattcaaacagggattggtttttttgatcatatgttgactttgctagctttccacagtgaaatggatatcaaaatgatttgtcatggtgatttagaagtagatagtcatcatagcgttgaagatatgggaattgctttaggtaaaactattttagaagctttaggtgataaaaagggtattacacgttatggacattttacaattcctatggatgaagcactagtaacatgcaatttagatatttcaggaagaagtttccttgtttttaatgtagatattcctaaagttaatttaggaaattatgaaagtgaaatgacagaagaattttttagagcggttgcttacaatatgaatgcaacattacatttaaatgaggcttatggaaataatgttcatcatgtaatcgaagcatgttttaaagcttttggaagagctttaaaagaggcggtacgcattgatgaaaaaaatatagataagattgtttcttcaaaaggagttttataaatgattgttattattgattacaatgtaggaaatttaaaaagtgttgtcggtgcttttaaaagaattggacttgaagctgttgtttctagagatgaaaaagttattaaagaagctaagggaattgttttacctggagtaggaacttttcctactgcgatgaagaatttagaaaagtatcatttagttgatattttaacagagcgaaaagaggcaggaattcctattcttgggatttgtttaggaatgcaaattttatttgaaaaagggtatgaagtaaaagaaacaaaaggactaggatttattccaggttcagtacgttatatggatattgatgaaaagattcctcatatgggatggaatcaattacatataacaaatcatcaaccaattttgaaatatgtacatgaaaatgatgatgcttattttgtacattcatatatggcacattgtaaagatgaaaatcttgtagcgtatacagattatggaactactaaagttacagctttagtgcaaaataaaaatgtcattgggtgccaatttcatcctgaaaaatcaggaatggttgggcataaaatattacttgcgtttaaggagatggtcgaatgttagttattccagcaatagatttaaaagatggacaagcagtacgtttatttaaaggagattataatcaaaaaacggtttatagtgatcatccagaagaacttgctcaaacttttgaaaaagcaggagctatttatttacatgttgtagatttagatggcgctaaagatggttttgctaaaaatttagaaacgattaaaaaaattagaaatagcacaaaaatgaaaatagaacttggtggaggaatccgtgatttgaaaacagttcaactctatttagataaagtaggaattgatcgtgttattttaggaactgcagctttaaaagaccccgaatttttaaaagaagcattaagacaatatggcagtgagaaaatagttgtcggtgtagatgttaaaaatggttttgtttctacagcaggatggttagaaacaagtcaaatgccttatattgaatttattcaatatttggaatctattggtgttggttatattgtagcaacagatatttctaaagatggaactttgacaggacctaattttgaaatgtatgatgaaatcgctaaaaacagtcaaattcaatttgttgtttctggaggaattaaagattttgataatattcaaaaagttgctcaaaaagattattatgcatgtatcgttggaaaagcttattatgaaaagaaaattgatttaaaggagacaatcaaatgcttacaaaacgtataattccttgtttggatatcaaagatgggaaagtggttaaaggagttaattttgttgggttaaaagatgttggagaccctattgaacttgctaaaaaatatgacgtacaatgtgcagatgaagttgtctttttggatattacagcttcttatgaagatagaggcattatgaaagatattattgaacgcggggcttcagaactaacaattcctctagcagtaggaggtggaattagaacattagatgattttagaatgattcttgcctcaggtgctgataaagtttctgttaattctgcagcaattattaatcctcaactaattaaagaagcagctgatgaatttggggttcaatgtgtagtaattgctattgatgccaaaaaaagagaagatcaaagtggatgggatgtctacgttaaaggtggaagagaaaatacaggtttagatttaattgaatgggtaaaaaaatgcgaaagtttaggtgctggagaagtattgcttacttcgatggatgctgacggaactaaagcgggttatgatattgaaatgcttaatgctgtttgtaaggctgttgacattccagtaattgcttcaggaggttgtggaagcattcaagatattattgatgtttttgaaaagacaaatgtagatgcagctttagtagcttcacttttccattttaatgaagcaactgttgaagatgtaagaaatgaatgtaaaaaacatggtataaatgtaaggagaacaagataatgagaccagattttaataaaatggaattaattccagcaattgtccaagattatcaaacaaaagaagtattaatgttagcttatgtcaatgaagaagcttatgataaaatgttagaacttaaacaaactgttttttattcaagaagcagacaaaagttatggcataaaggagaagaatcaggacattttcaagatattaaaggaatgtatttagattgtgatttagatactttattgatttatgtcaaacaaacaggagcggcttgtcatactggggcttattcatgcttctttaatgaagtacaagcttatgatgcaagagatatttttagagaattggaaaaaacaattgctgatcgtaaaattcatccagttgaaaaatcttatacaaattacttattgaatgaaggggttgataagatttgtaaaaaagtgggtgaagaggcaagcgaaacaattattgcagcaaaaaatgataataaagaagaattggttggagaaatatctgatttattattccacacttttgttttaatgaatgatcgaggtgtcagtttagaagatattcaaaataaacttaaagaaagacatcaagtaactggaaacaaaaaagaatttcatacaagaggagattattaaatcttctctttttatgtttcatattatgaaaaaatgtaaacgaatacatgaaaatgaatataataataatcaatgataaaggaggaattcaaatgggatttaaagaaggatttttctggggaggagcaacagctgcaaaccaatatgaaggtggatggaatgaaggcggacgaggtccagctttaacagattttacaacaggtggaagtgtcaaagaaccaagaaaagtaacttggatcgataaagatggaaacgctcatgcaacaccacaagttcattttgatgatgctttaccagaaggcggagatcattatgcatgtttagatgattatctatatccaaatcatgaaggtacagatttctatcatcattataaagaagatattaaattatttgcagacatgggattcaagatgtttagaatgtctatttcttggtcgagaatttatccaaaaggaattgaagaaacacctaatcaagaaggtattgaattctatagagatgtatttaaagaattaagaaaatataacattgaaccattagtcacaattcatcattttgatacaccaatttatttagtggaaaaatatggcgattggcaagatcgtcaatacattgaattctttgtaaaatactgtaaaacagtctttacagaatacaaaggacttgttaaatattggttaacatttaacgaaattaataacacattaaatgttattaatatgtttggtaatggtacaactaatgaagattataaaaaacgtttaacacatttacattatcaatttgttgccagcgcaaaagctgttaaattaggacatgaaattgatcctgaaaataaaattggttgtatgttaggtggagcaattacttatcctcatacatgtgatcccaaagatgttttattaaatcaacaaacaatggaagaaaatttctggtattgtggagatgttcaatgctttggtgcttatcctccatttgcaaagagaatttggaaagagcataacattatagatttagatatcactgaagaagatttaaaagtcttaaaagaaggtgttgttgatatgtttacatatagttactatatgacaaacaatgtgacaactcatgaaacagaagatacagtacaaggtaactttgcggcaggtattcgtaacccatatttaacttattcagattggggatgggccttagatccattaggacttcaatattcgttagaaaaaatctatgaccgttatagaattccactaatggtcgtagaaaatggactaggtgcttatgatacagtagaagaagatggatcaatccatgatgattatcgtattgattactatagaccacatattgaagcgatgtcagctgcttgtgataatggggttgatttaatcgcttatacaacatggggatgtattgatttagtttctgctggaactggagaaatgagaaaacgttatggtttcatttatgtagataagcatgatgatggaactggagatttatcaagaagaccaaaagattcattctattggtataaaaaagtaatagaatcaaacggaactgatttagattaatttaacagataatttatgaataagagaaaatagaaatattttctcttatttgttataataaggaaaaatggaggataaaatatgagagttatagattatcatatgcatacacatttttcaggggatagtgaggcaaatcctagagaacatgttttaaaagcaatagaaatgaatttagatgaaatctgttttacagatcatcgtgattttgattatccaatagattcttttgaattagatgttgaaaactattatcaagagattcaaagtttaaaagaggaattcaaagatcaaataaaaattaaatggggtattgaaatgggattggatttagatcatcaagaagaaattgaaaatttaattcaacaatatccttttgattttgttattggatctattcatgtgattcatcatacagaattttattatggtgaattttttaaaggaaaaaccaaggaacaagcacatcgtgaattttttgaagaaacattaaaatgtgtaaaagctttcgattgttttaatgttttaggccatttagattatattgtaagatatggaccttatgaggataaaactgttgatcatcaaaaatatcaagatattatagatgaaatctttaaaacacttattcaaaaaggaaaaggtattgaagtcaatacatcgggatatcgagatttaaaaacatgtggatttcctaatttcgaacaggtacaacgttactatgatttaggaggacgtattattaccattggtactgatagtcatacaagtgatcgtgttggtgaaaattgtttaaatgtagcaaaaaaatatcaggaaattggttttgacgatgtcagtacatttacgcaaagaaaaagagattaacacaatgttctttttttctagatatggtataatatagaaacaaaaggagtgaagaagtatggaattatatactaaagaaagtttaaaagaagttattgaaaaatcaaaggatgaattttatatgccaaaggcattatttgatcattataaaagtttaagattagaaacaaaacttgcttatgtttcaattctagaaacaatgaaaaataaagcgggttatacaactgaaaatacagcttatattaaagtggataatccccaaattcaagtaaatcttgcaaaacttgctaataaagaagttaatcaagaaaaagtaaataaatatttaaaagaattagaagaagttgaattaataaaggtagataaacaaaatatttttgtttatgatgttttatcatgattcattttttaacacaaagatttattgaaaattatggtgattataaaaatcaaaaagtaagacaagcttatggaacgttatgttccattttgtccattatatgcaatattgttttagttatttttaaaataacaattggtttaattgttcattcggttgctatccaagcagatggtttaaataacttatcggatgtaggaagtaatttagcttctttatttggctttaaacttgctaataaacatcctgataaagatcatccctatggtcatggacgttatgaatatattgcaggaatggtgattgcttttttaattttagtagtaggtattcaatctttaaaagaatcagttgttaagatttttaatcctgaaaaagttatgttttcatttgttgcagtagtgattttaatattttctattttagtgaagctatggatgtattattttaataatcaaattggcaaaaaaattgattcatcatctttaaaagctgcaggacaagatagtttaaatgatgttgtgacaacatttgcaacacttgtttctttaatacttacattgataactgatttaccagttgatggaattattgggacaattgtttctttaattgttatttttgcaggaattaatgtatttaaagatacaatcaatcctttattaggattggcacctgataaagccttgatagatgacattgaaaattttattatgtcatatgataaacctttaggtattcatgatttaatgatgcatgattatggaccaggaagaatgtttatgacacttcatgtggaagtagattgtcaagaagatgttatgaaaattcatgaagaaatcgatgatattgaaagagcaattcaagaaaaatatcatattcatacgaccattcattatgatccagtggatgtgcataatccaaggttattagctttaaaacaacaagttttagaaattgtaaaaggaatagatgaacattattcgattcatgattttagaatggttccaggaaagaatcatacaaatttaatatttgatgttttaataccagctaatgatcaaattagtcatcaaattttaaagaataaaataagtgctgaagtcaaacaaatcagtgacgaatatcattgcgtcattgaaattgatcatgcttttgtttaaagaggagaaatcctctttttatttattgtgatacttgtatatacataataaaataatgtttatgaggaggatgtttatgaaaaaagtaatgttaggtgtttctttatatccagaacaagaaacattagaagaaattgatgcctatttaaaaaagcatcgacttatggtttaaaaaaatatttacaagcatgttttcagtaccagggacaaaagaagaaattattgcttattttaaagattttacaaaaatcgttcataaatatggcatgattgtttctggtgactgtaatagtgaattatttcatagattagaagcaacagaaacagactttcggtttttaaagatattggggtagatattttaagaatggattttagttttaacgatgaaagggatgccactcttattaataataaagaaggtattaaaattgaaatgtctacaagttttattgatgtcattgaaacagctattaaaaatggagttaaaccagaaaatatttctacatgtcataatttctatccagaaagatatacggctccaagtttagaagctattaatgatattaataattattggaaagctaaaaatattccagtagctatctttatttcaagtttagttaaaggaagtcatggaccatggccagtgagtgatggtcttccaaccattgaagaacatcgagatatgccgatagaaattcaattaaaacactgtttagctttagacaatatagatgaaataatcattggaaatgcctatgctagtgatgaagaatttaaagtaatcgatcaagtaatgaaacaagtgtatgttgacattcctaaaaatgaatctttagggtttttagcagattttgtgccccatggtttaactaaaagaataccttttaagattcatttagataagggtattactgctttggaaaaagaaattttatttaattatccaagtcatagtgatttaggtgattgtatgaattatatgttacgttcacgttggacaagaatgatttataaaggaaaagaaattccgtgtcgtccttgtgataaagcgtactatacaagggtgatgttgtaattgtcaatgacaatcttgtacattatcgaggagaaattcaaatcgttttaaaagaaatgaaggtagatggtcaaagaaatttactaggacatattgatgaaaatgaaatctttattttagaacatattaaagcaaaagatgtttttacctttgttgaataaagtagatagaaatctactttttcttttgtttttatagctaaaaagaagaaaatatgacataatggttgaggtgatattatggaaaatacaaaaaaagaaaagaaagaatatacaaaagattcattagatgatggagtcattacaacaggttttttagaagtattacctgatggatttggttttattagaaatgcaaattatttatcagatcctcatgatgtctatgtctctcaatcacaaatttataaatttaaattaaaaacaggtgattttattacaggtgttgttagggaaccaaaagcatctgaaaagtttagatctcttttacatattcaaaaaatcaatcattatgatttagaaacagcaatgaaaagaaaatcctttgaaagcttaacaccaatttttccaaatgaaaaaattagcgttggcaaaagtggaaaaatagcgatgagaatgatagatttacttgctcctattggtaaaggtcaaagaggaattattgtttctcctccaaaagcagggaaaacaacccttttaaaagatatagctttagctgttaaagaaaataataaagatatacatattttaattttattaattgatgaaagaccagaagaagtaacggatattaaagaagctgttgaaggagataatgtggaagttctttattcaacatttgatgaaacaccagatcgacataaaaaagtatcagaaatggtcattgaaagagcaaaacgtcttgttgaacatggtcaagatgtaatgattttattagatagtataacacgtttaacacgttcttataatttgatttgttcgccatcaggaagaacactttcaggaggattagatccaaactgtctttatatgccaaagagattttttggtgcggctagaaatatgagagaagggggaagtttgacgattcttgcaactgctcttgtagatacaggaagtcgtatggatgatgttatttatgaagagtttaaaggaacaggaaacatggaacttgtattatctcgtacaatgcaagaaaaacgcatttttccagcaatcgacatagctaaatctggaacaagaagagaagatttattattaagtgaaaaagaactacaagtgaaccatatgattcattattcattaaatgggacacgtgcgagtcaaaatttagatgatgcgcttttattatttagaaatactaaaaataatgatgaacttattgaaacaatgttaaaaagaaaagtaggatagaatttctatcctttttaaataggtgttatatgatagaaataagacatgaaaaacttaatatagaaaaaccttatagatgtattgttgtttctgatattcatagtcatttagatcgtttcaaacagcttttaaaagaagcacgatatactacacaagactatttgattattgatggagattttgtagaaaagggaacacaagccatagaaacagtacactatcttcaatatttacaacaaaaaagccaaagggtatatgttttactaggtaattgtgaatatgctttagatgcattgattaatgatgatgatctttgtcaagaaatgttacattacttacgtaaaattggtaaaagtggaatgattgatcaaattgtttctcgaaaacatttagatttgaagaaagaaaaaccacaaattttacaaaaaattgtaagagaatctttacaagaagaacttaattatatagcgagtttgcctacttcaatagaaaccgatgattttttatgtattcatgctgggattgaaaacaaaaatgattggcaaaatgcaccgctgtcttcatttatcgaaaaaagagattttcaaaaaataggtcattgtttaaaaaaatatgtcatagtaggtcatttgccaacgtcaaatttttatcaaagtcaaattaaaaatgatgttttgatggattttgataaaaaaataattagtattgatggcggaacaggggttaaatttatcagtcaattgaatgcacttattattgaaaatgatggtaagaatttaacttttaagaatcattttgtacaacctttaccaatctatagaataaaacaagacaaatttgtagaaaataaggaaaatcataaggtttcctggccaaattttgaaatagaaattttagaaaaaagagaagaattttcattttgtaaagttattcatacaaaccaaatgttatggatcaaaaatgaatttatttatttgaaaaataaacacttttattgtttagatgattatattgatcattttataacggttcatgaaaatgaagatgttaaagtaataggattatatggaaaatttgcttatattatcaaaaataaagaaataggctggatagaaagcggatatttagaaaaaatataattatttagaaatctttagaataatttagattttttttaagaaatatgggttaaaataaaaaggaaggtaaaaatcatggaacttagaatacttcagtattttttaatggttgcgcgtgagaaaaatattacgcgtgcagctaagcaactacatatgacacaacctacattatcaagacaattaatgcagttggaagatgaattaggaaagcctttatttattcgaggaaaaagaaaaatagaactcacagatgagggtgttttacttagaagaagagcagaagaaattttatcacttgttaataaaacagaacaagagattactcaaagtgaagaagaaatggttggtcaaattatgataggaacgggtattttttcatcttcacaaacggttctttcgcaagtgattgaagagtttcatgatgaataccctcttgtaaaatttgatatctatgtaggaaatgcggatttgattaaagaaagagttgatcaaggattagtagatattgggattttgttagaaccagtagatatttcaaaatataatcatttacgtataccgcttcaagaaaaatggggaatcattgtttcaaaaactaattctttggctcataagccctatgttaaaaaagaggatttaaaagaattaccattgtttttaacaaatagagaaattgttcaaagtgaaatttctaattggttaaaaggggatgtttcgttgcacagcatgttttcttataattttgcttcagcaattcttccttttattcaagatgatcaaggagcagcgattacagtagaaggagcctatcaggtgttaaatcaaaagaatatttgtttcattcctttttatccagaactatcaacaaataccgtttttatatggaagaaatatacacgtctttcaccagttattgataggtttattaaaaaagtacaagaatatttagaaaagagtaggagtctatatgaaaaatagaaaaaaattagtgattattttgattggagtaatcgtcttaggaatagttttatttgtttatcaaacatttataaaaaaacaactgcattttaaagaaaatatgacagtagaaattaatggaaaatttaatcccaatagctatattagtgaagttgaacatggaagtgttaaagatgtagcatgtcaaagcaaaaatttaaatattaaaaagctaggaaaatatgaagtgacatatacatataaaaatagagaatatacaacaacgattcaagttgtagatacacaaaaacctgtatttaagggattggatgatttgacggtttctttaaatacaacaccggatttaaaagctggtgtggaagtaagcgataatagtttagaagaaattaaatacaaaatagatgataaaaaaatagatacctcaaaagaaggcacatatgaagttacttatagtgcaaaagatagttcaggtaacaaaacaatagccaaaagaaaaatagaagttattaaaaaaatcggaagtgataaacaatcaaatgaaaaagtggtttatttaacatttgatgatggaccatcagaaaataccaaaaagattatggatattcttgcaaaatatgatgctaaagcaacattttttgtaacaggaagaaatcaagattataattatttgattaaagatgcttataatgcaggacatacgattgctcttcatacgtatagtcatgaatattcaactgtctatgcttcagttgatgcttattttgatgatttaaataaagtaggtcaaatggtaaaaaaagaaatcggttttgtaccacattatattcgtttcccaggtggaagttcaaatacagtatcaagaagatattgtcaaggaattatgtcaactcttacaaaagaagttgttgaaaaaggatatcaatattatgattggaatggagattcaacagatgcttcaggaaatcatgtagctgtagataagttgattagaaacgggacatcatgtcatgataataatgtcatgattttatgccacgatacacaagctaaggataccactgttcaagccttacctgctattattgaacactataaaaatttaggctatacttttaaaggaattgatgatgcgacatatgccccacatcaaagtgttaataattaataaaagtaatgttcatttttggacattacttttcattttattaatttcttcttttattttttcaatacttttttctaataaatcataatcattttgattttgtttagaaagggaattttgatcttgtaaataagagatataagcactgtttaaagagagcatatctcctagagttgttaaaaaagcgccaataatggcctgttcatcatttgaaaaacattcattaaatgattgtgaaatgatgacaatcatctgattaagtaaaacagtattcatgtaaggtagagacatataatcaccaatatattatatgtatcaaaagatgagttgactgaacgaaataaatatttattgataaaaaatatagttattaaaataaaaaactattgacaaacaaaaaaagaggtataatatataggcatacatataaatgagcgatgaacaagatacgattttacatccgcttcctatagagaacattcggttggtggaaagaatgtaggtaatgatataagaccatcacttgtgagctattttcttgaaataaaagtaggggaatcgtaatttctgcgttaaaggaatagcattataaaaagatgtgaaggggcgattaaatatcgcaatctaagtggtaccgcggaacaaggttttcgtcttagcgtaaagttaagcgaaaacctttttatatgtgatgattgatttaaaagagggggattcatttatgaatggtttactattacttggattaagtgctttaattttagtagtggcttatttattctatggtcgttacttagttaaaacatggggaattgatccaaaagcaacaacacctgctgttgcaaaagaagatgggacagactttgtacctacaaacaaatggtcagtctttgctcatcaattctcatcaattgcaggagctggacctgttactggaccagttatggcaatgatgtttggttggctaccagcttttttatgggttatcgttggtggtgtattctttggtgctgtacaagattttggcgcactttatgcttctgttaaaacagaagggaaatcaatgggacaaatcattgaaaaatatattggacgtaaaggtaaaaaattatttttcttattttgttggattttcacattaattgttattgcagctttcgctgatatggttgcaggaacatttaatggaattagtgctgatggggctaaacttgctccaaatgcaagtgctgcttcaatttcaattttatatgtctttgtagcaatggcctttggtttattcttgaaaaaagttaaactagaaggtttaccaaaagtgattcttggtattgctttaattattgctatgttagcacttggaattatgtttccagtatatgctactaaaacaacttggatttatgttgtctttgtatatattttctttgcttcagttacacctatgtggttacttaaaacaccacgtgattatttaacaacattcttatttatcggaatgatcgttgctgctgtaattggtgtatttgtaagcaatccaacaattacaacacctgcttttgcaggatttaaatctgcttcaggaagttatatcttcccaacattatttgttacaattgcttgtggtgctgtttctggtttccattcacttgtctcatctgaaacaagttcaaaattagtagaaaacgaaaaagatatgttacaagttggttatggttctatgttacttgaatcattacttgctatcttagttatcgttattgttggtgctttaccaaacttaaaagcatcgggtgtcttagatagtacacttgctaatatggctttagctgatacagcaacaccatttactaaattttcagctggtgttactggtttagttgctcaacttggtttacctcaatcttggggattatgtattatgacaatgtttgtttcagctcttgctttaacttcattagatgctgttgcaagaatttcaagaatgtctttccaagaattctttgaagtagaagaaggacaagaaccaagtggtttagttaaagttttaactaataaatacgtttcaacaattatttctttagtttgtggatatttattaagtttaggtggatatgttaatatttggccattatttggatcagctaaccaattattagctgcaatggttttaatttcattagctgttttcttaaaagttactggaagaaaaggatttatgttatatatcccaatggtattaatgtttatcgttacaatgacagcgttagtacaagctatctatggaatcgttatgaaattatttgtaactggtggatttgtcttaatggttgatggtttacaattagtagtcgcaatcttacttgttgcattaggattaatgattggtttcaactcaggaagtaaacttgtaaaagaaaaataaagataataaaaaagcttcagatgaagctttttttgtgttttagttcatataagaaccaccatttatatctataccttgaccagtaatatatttagaggcatcacttgctagaaaggcaataacttctgcaacatcatctgtttcacctaaacgtccaagtggaataccagcagcactgtaatttgtattagctgtcatatttgtgttgatgacactaggacaaacagcgttaacattaatattataagttcctaaaacttttgcataactttttgtagcagataaaagaccacctttacttgcagcataacttacagaagaagcgatacctccaattcttgcagccacagaagaaatgtttatgatctttccatatttttgttttttcattattttaataacttctcttacacataaatgagcacctcttaaattaatattcatacaccaatcccatttatcagcatccaaatcttcaataggggttgttggacaaacaccagctccattaatcaaaatatgaacagtgtgcattttttctaatgcaaattcaaatagatgttcaatatcttcaggattagaaacatctactttgcatggataacagtgacatcctgtttcttcttttagttttttagcgctttttgttgcttgctcaatatttaaatcagctaaaacaacaccagccaatcctttttttgcaagtgtttttgcagcttcgtaactgattccgccagctcctccagtaacaacagcatattttccttcaaattctttattcataaatataatcctccttatctttattataaaaacaaaaaatagataaatctaatagatattaagaagagaatttatagatatattttatagaaattaggtatttttatttaaggtgttttgttgtgtatttgacgataattagtatataatagttatcaaaaaggaagtgtcaaaatggaaaaagaaaatatatacgctaaaagaatagatcaagtacaaatgtcatctattcgtgttgttatggaaaaggttgaaaaattaaagagtcaagggaaaagtgttgtatctttatgtgcaggagaacctgattttaatacaccagagggaattaagaaagcaacgatagaagctttaaataataatcaaacgcattatagttctaatagaggatatttaggtttaagacaaaaagtagctcaattgttaaaggaacaaacaacagttgattatgatagtgatcaagaaatcattatgacttgtggttgtagtgaagcaatcaataatgcatgtcttgcttttattgaaccaggagatgaagttattatatttacaccagccttcgtttcttatcaaaatacagttttattatgtgagggaattcctgtagaaattccattaaaagcaagtaatgaatttcaaattgatattgaaaaattgaaatcaaaaattacaaataaaacaaaaatgatgattatcaataaccctagtaatccaacaggagctgtttatcaaaaggaaacattagaaaaggtatgccaactagctcgagaaaacaatattttaatattagctgatgaaatttataatcaactcgattatgaaaagcaatatgtttctgttgcctcatttgaaaacatgaaagattatacaattattgttaatggtttttcaaaagcatatgcgatgactggttggcgaatgggatatattgctgcaagtaaaaaacatattgatcatattttaaaagtacatcaatatacaacaacttcacaaatgacatttgcgcaaataggaatggctaaagcaattgatcaagaagatgtaaaaaaagaagttcaacatatgatccaaacatttcatgaaagaagaacattcattatggaacaattggatcaatgtgaaaatctttcatacattaaacctcatggggctttctatattatggttgatgtttctaagacgggatttaatggacaagagtttgcggataagttacttgattatggtgtagcggttgtaccagcaagtggttttggaaaaggtttaaataattttattagaatttcttttgcttcatcaaaagaaaatattgaagaagctttcagtagaattaaaaacttattatcagagttaaaagaaaaatagaataaaaatttatataggctttaatgataaatattcattaaggcttttttattgacatacattaaataacattgttataataacagtgttatttaatgatggaggcaattatgaggcaagaaaccgtaggtgttacagaaaacctattaaaaagtgcaacagaagaatttttagaaaaaggatttatgaaagcaagtctaagaaatatatctgccaaaagcggggtcagtacgaattctatttatactcgttttaaagataaagaaggattgttttcaacaatcgtcaaagaaacagcggatgagttgatgaatatttatcttgagagtattcaaaaagcaatctatagtcctgatcttaatcaagctaattatgaaggagaggaaggaacagattttgttttagattatatttatcaacattttacagagtttaaattgattttttgttgctctaccggttctcaatatgaacattttttagatgaacttggaaaaatcgaagaatcttattaccaagagcttgttgataaatatggtaaagaagattttacagtagatccattctttattcatgtattttgccgggcaggatggcaaacgatgtatgaacttgttgcacatgattgttcttataaagaagctcaatcatttatgaatagcacaaagttatttaatgttgctggctggaaagcagttatggggattgatgagtaaatagacagggaaacctgtctaaagttaacatcaatagttagcaaaaactaactgataggagagattttatgaaagaaaagaaaaaaagtacattattgaagttgatacactttgcggggaatcataagtattatgtttatgcttcatgtattttagctgctatgagtgcttttattgctttagttcctttttacgatatgtggcgtatcctcaaagaggtattagaagtaagaccaaacttcaatgaagcaatccatattaaaagctatggatggcatgctgttatatttgctttgcttgcaatgtttttttatattgcagctttaatgtgttcccataaagcagcgtttagagtacaagcaaatatgcgaacaaaaatgatggaacacattatgaagcttcctttaggatatgttgaaagccaaggaagtggaaaaatcagaaaaattgtgatggaatcaagtgctgcaacagaaacatttttagcacataacgtgccagataaagttgtttctaaagcaacaccaattggtttacttataatgatggtaatctttgattggcgtttaggtttaatgagtcttattcccgcaattattgcttttgttttaatgattacagcaatgatgggaccaaagatggcagaagatatgaaacaatatcaaaacgctttggaaactatggcatcagaagcagttgaatatgtaagaggggtacctgttgttaaaacttttggacaaacaattttctcttttaaaaggtttaaagaagctatagacgaatatgaaaaatggacgttggattatacaaagagtatgatgaaaccaatggtttgttttacgacttttgctaatggtatctttgccactttgattattgctgcttatttatttgcgggaaatcaaattacggatcaatttattttaaatctattcttctatattttaattacctctattttaacgacaactttaatgaaagttgcttatgcaggtgaatcaaaaatgcttgtagaagatgctttaaatcggatggattcaattatgaaggtacaacctttacctgaaagtaaacaaacacaagtaccaagtgatgcttctattgatatagaaaatattagttttatatatcaagatgcttcaactaaagccattgacaacttaagcatacatattaaatcaggagaacatgttgctttagttggaccaagtggcggaggtaaaacaaccgtcgcttctcttatctctcgtttttgggatgtaagtgaaggaaatattaaaataggacatgttgatgtcaaagatattgaacaaaaagaattaatgaatcaagtatcttatgtttttcaagatagtcgcttatttaaaatgagtattttagaaaatattcgtatgtcaagaccagaatcaagtgatgaagaagtcatgcaagctttaaagaatgcccaatgtcaagatattattgataaatttcctgatggagttaatacagttataggttcgaaaggtgtttatgtttctgggggagaaagtcaaagattatccattgctagagcttttttaaagaatgctccaattcttattttagatgaagcaaccgcttttgctgatccagataatgaagtattagttcaaaaggcttttgagaaactttcaaagaataaaacagtcattatgattgcccatcgtttatcaacgattactcatgcagattgtatttatgtattagaaaatgggcaggttgttgaaagtggaaatcatgaagaattattagaaacaaaaggtgtttatgaacatatgtggcatcaatataatcaatctgttaaatggaaagtacaaaaggaggatgaagaataatgattgaaaaattaaaacataaatatgctttatcttctaaaggagccaaagatatggtaagagcttttatagcagtgacactttctaaccttgttttaatgcttcctgtgggattactttatttactagcatcttatttattagataatcaattaccgcaagaaaaatttgttttctttttgatagctattgtagttattttaatatgtattgctttaacaaacgtttttcaatatcgtgctacttttttttcaacatatgttgaaagtggtgttagacgtcgtacacttgcggaaaagttaagaaaacttcctttatcttattttggtaaaaaagatttagcggatcttacaaatacgattatgtctgactgtgctcttttagaaacagcaagttcacattggattcctgaattaataggagctatgatttcaacaactattattgttatcagtttattgttttttgattttcgtatggcacttgcagcaatttgggtgatgccaattgcttttgcaattgttctttattcaagaaaaacgatgcgtcatacacataaaaaaacaaatgaatatcgtattgattgtttagatggcattcaagaaggattagaaacattaagagatctaagagcaaataatatgtgtgatcaatatatggaatcacttaataaaaaaatcaaagctgttgaaaagcatgctatttttgcagaatttacaaatgcagcatttgtttgtagtgcccaaatgatcttaaagcttggtatggggacggttgctgtagttggaagttatctattagtaaagggagaaattacagttttaacattctttatgtttttgcttgttgtgacacgtatgtatgagccattacaaatatctttacaaaatttatcagcaatgattagtttagatacaaattgtaaacgtatggatgaaattttatctcatgatgaacaaacaggaaatgatacgcttacaaatgagggttatgatattgtttttgatcatgtggcttttgcttataatcaaaaagaacaagtattgtctgatgtttcatttactgctaaacaaggtgaagtaacagctttaattggaccaagtggtggtggtaaaacaacgatttctcgtttagctgcacgtttttatgatattgatagtggaaagattatagttggtgggatggatatttcaaagattgatccggaaaaattattagagctttattcaattgtttttcaagatgtaacactttttaataatacaattatggaaaatattcgtattggtaaaaaagatgcaacagatcaagaagtgatggcagcagcaaaacttgctcattgtgatgagtttgttgaaaatatgccagatcaatggaatacaatgattggtgaaaatggttctgaattatcaggaggacaaagacaaagaatttcaattgcgagagcatttttaaaagatgctccaattatcttaatggatgaagcgactgcttctttagatgtagataatgaatcaatgattcaagagtctatttctaagttaatagaaaataaaacagtattaattattgcacatcgtatgagaacagttgatggtgttgatcatattgttgttttaaaagatggagtagtctttgaacaaggtaaaccacaagatttaaaacaacaaaatggtatttataaacatatggtagagatgcaaatgcaatctcataattggaaatatgaataattgattaccaagatattttaaagttttcaggaaacatttgatataaaagataacctgcttgtttaggtgataaatcatatttacctagaatatagtgttgatacatgattgaagcaccaccacaaaagacatccaataaaagaagatctttatcttcaaagtggatgttttttgttttacacatctcaataacggtattataagaatattgataaataaaatcacctaaagaattaattcctgtataatcaaagtattttatacaaatttccgatagatttaagaatcaaaagtattgggtctgcatctattaaatttgacaggtatccaaatgcaactttttcacgtgtctttaatgatattttaggtttcagaacaatttgttcaaattatgaagaagttctttgtcttgaaacggaagaaaaaataagagttgtcgatatgtcaaaaggaaaatctaatgatgatgggtatcgaggcgtacatgtctattatcaaaaagataataaacattatccaattgagatacagtttaatacttactatgataggcaattaaatgattggttacatgataaattttataaacgaggatatgatagcttttatggtcaaatattgcgtaaatattatgaaaatggtagaataaaattagctgaagaattagaggaggtactagaaaatgtgttacatcattgcgaaaagatttaaaaaatcaggatgcattgcactaaaagcaaagcgtggaaaagagttggctaattttacaacaaatttacaaaagaagctaggatacgatattcaaattgtagcaatcactagacctactgcttatggagaatatgaaccttatcattttgttaatagttttgaagaatttagtaaagaagcaagtctattatagtattacaagcaatctacggattgcttttttaatgtaagtcataaaaaaatatagtatgattaatatagaatatcttgaaaagggataggtgaaaatatgacaaatagaactaaattacaattagaagatgcttttaaaaagcttttattagaaaagccatttcataaaataaccattaaaaatttaacagatgtttgttatttaagcaggatgtctttttattatcatttttaagatttatatgatttaacagaatggattttaattgaagatgctaaaaaagcacttaatgaaaagaaagattatgctcattggaaagaaggattagaaaatatctttgaagctgtttataaaaataaaccttttattttaaatgtttatcatgatatttctaaagatcagatagaaaaagtattatttaaacttgttcatggattgattgaatcaattgttgaagaaagaagtattgaaacaaatttaaatgaacaacaaaagaattttattgcttatttttataaatatggttttgtagggattatgcttgattggatagaaaaaggaatggatgaaaattataatgaaattgttgatgatttagaaaagacagttcatggaacaatagatttatcaattaaaaactttacagataataagaaatgataaaaattaaatcatttcttttttattgtaaattttaattcaagaggggaatgataaaattaaggtatcaaagaaaggtggaacctatatgaaaagaagtatcaaaatagcagcaacaacagctgcagctgtttcatcagctatgcttgttaaaaaagcaaaagaaaataaagtagaagaaaaagaaaatacgtatcgtaatactgaacttggtaaacatgataaaaattctaaaggaatttattatacaaatggtaactatgaagcatttgctagacctaaaaaacctgaaggtgtagaaaataaacaagcttatttggtaggtagtggacttgcttcattagctgcagcatgttttttagtaagagatggacaaatgccaggaaagaatattcatattttagaagcaatggatattgctggtggggcatgtgatggcatttttgatccttcaagaggatatatcatgcgtggtggtagagaaatggaaaaccactttgaatgtttatgggatttatttagaagtattccttctttagaaattaaagatgcgagtgttttagatgaattttattggttaaataaagaagatcctaactactcattatgtagagcaacagtgaatcgtggacaagatgctaagaccaataatcaatttggtttaagtcaaaaagggtgtatggaaattatgaaactctttatgactaaagatgaagatctctatgataaaacaattgaagatgtctttgatgaagaagtttttgattcaacattttggatgtattggcgtactatgtttgcctttgaaaactggcacagtgctttagaaatgaaactctatttccaaagatttattcatcatatatcaggattacctgattttagtgctttaaaatttacaagatataatcaatatgaatcccttattttaccaatgaaaaaatacttagaaaaacatgatgtagattttcaatttaacagcgaagtaacaaatgttatatttgatacaacacctgataaaaaagtagctaaagttattgaatgtaaagtaaatggtaaagacaaaaatattcaattaactgaaaatgatttagtctttattacaaatggtagttgtgtagaaggaacaatctatggagatcaaaatcatgcacctaatggagatagtgaagtacgtgtgagtggatgttggaatttatggaaaaatatagcaaaacaagatcctgcttttggacatcctgaaaaattctgtagtgatattgaaaaaacaaattgggaatcagctacaattacaaccttagatgataaaattatcccttatattacaaatatctgtaaaagagatcctcgtactggacatgttgtaacaggaggaattgttagttgtaaagattcatcatggcttttaagttggacaattaatcgacaaggacaatttaaacaacaagataaagaaaaagtatgtgtttgggtttatggtttatttacagatgcaattggagattatgtgaaaaaaccaatgaaagaatgtacaggaaaagaaattacaatggaatggctatatcatcttggtgttcctgaagaatacattgaagactttgcgacaaacagtgcaatctgtataccaacaatgatgccatatattacagctttctttatgccaagaagaaaagaagatcgaccagatgttattgttgatggggcagttaactttgctttcttaggacaatttgctcatacacctagagatactgtttttactacagaatattctgtaagaacagctatggaagctgtttatggtttattaggtgtagatcgtggtgttcctgaggtatggggaagtgtttatgatattagagaattattggatagttctgttaaattgatggatggtaaatctcctcttgaaataaacttaggtcctttaaatatgtttaaaaagcctcttattaaaacagttaaaggaacagctatagagaaattattaagagatcatgaagtattaaaagataatatgtaataataaagaggctgtaacctttcgaaagtagttaaaaatctacttactcgttacagccccttattttttaaattattgttgatagaaagggataaaaggaaaaataaaaaagccttgaaaaatcaagactttttaataaattatttacaagcttcttcgatagcaacagcaacagcaacagtagctccaaccattgggttgttacccataccgattaatcccatcatttctacgtgagcaggaactgatgaagaaccagcgaattgagcatcactatgcatacgtcccatagtatcagtcataccatatgaagcaggaccagcagccatgttatcaggatgtaaagtacgtccagttccaccaccagatgcaactgagaagtattttttaccttgttcaatacattcttttttatatgttccagcaactggatgttggaaacgagtagggttagtagagttaccagtgattgatacatctacaccttctttatgcatgatagcaacaccttcacgtacgtcatctgcaccatagcagttaactttagcacgtggaccatcactataagcagttctagatacttctttaacttctccagtgaaataatcgaattgagtttctacataagtgaaaccattgattcttgagatgattttagcagcatcttttcctaaaccatttaagataactcttaatggattttttctaactttgttagctttttcagcgattttgattgcaccttcagcagcagcgaaagattcatgtccagctaagaaagcgaaacattgagtattttcatttaataacattgctcctaagttaccatgacctaaacctactttacgatcatcagcaacagatcctggaatacagaatgattgtaaaccaacaccgattgttttagcagcatcttctgctttagtatcaccatttttaattgccatagcagcaccaactgtatatgcccaacaagcgttttcgaaacaaattggttgtgtagattttacgatatcataaacgttgatacctttttcatcacaaatagcttttgcttcttcgattgatttgatatcatatttagctaatgcagcgttaatttgatcaattcttctttcataactttcaaataatgccattttttcgtatcctcctattattcttttcttggatcgatgtatttagcagcatcgttgaatctaccgtagttacctttagcagcttctaaagcttcattagcatcttttccatctttaatcatttccatcattctacctaagttaacgaattcgtaaccgataatttcatcatttgtatctaaagcgatacgagtaatgtaaccttcagttaattctaagtaacgaggtccttttaatttagtagagtatgatgtacctaccattgatcttaaacctttacctaagtcttcaagaccagcacctacaggtaatccaccttcagagaatgctgattgagtacgtccataaacgatttgtaagaataattctctcatagctgtgttaatagcgtcacaaactaagtcagtatttaaaccttctaataaagttttaccaactaatgcttcactagccatagcagcagagtgagtcatacctgagcatccaacagtttcaattaatgcttcttcaatgataccttctttaacatttaaagtaagtttacatgcaccttgttgtggagcacaccaaccaataccatgtgttaaaccagaaatatctttgatttctcttgaatatacccattttccttcttcaggaataggagcacatccgtgtgatgcaccacgatttacagtgcacatttcttcaacttcatgtgaataaatcattttttattttctcctttcatcacattaatgatcacaaacattaaaaaagaaataacgtaaaactacataaatttcttccttcaggtgaaggaattcacctgaacaaattataaagtgtcgattaaagaaagtcaatgaaacaagaaagataaataaatgaaaaaaggaatttttttgtatctatcaaagaatattttataaaaaaaggaacaaaatagtatttgaagttgaaaaaaagtagtcaaaaagggttgacacacaaggttagtatatgctaacttatagacggttagttacagctaacttcgtgttaataaatcattttttattgataccagatcacaaacccaaacaaaacaaaaatgaaagaaggaagtattaaaatggatttaattcaaagtattaaagcacgcgaagtattagactctcgtggaaatccaactgttgaagttgaagttagaagtgaatgtggagcttttggtagagcaatcgtaccaagtggagcttctacaggaatttatgaagcagtagaattaagagatggagacaaatcacgttatttaggtaaaggtgttttacaagctgttaaaaatgtaaacgaagtgattgctcctgaattaatagggtatgatgtttttgctcaaagagaaatcgatcaagcaatgattgatttagatggtactgataataaaggaaaattaggagcaaatgctatcttaggtgtttctcttgcggttgctaaatgtgccgctgattcattaggtatgccattatatcgttatattggtggagcaaatgctcatattattcctacacccatgatgaatattatcaatggtggggcacatgctgataacaacattgatttccaagaatttatgattatgccagtttcagctcctacattcaaagaagcaattcgtatgggtgctgaagtattccataatttaaaagctgtattacatgataaaggattaaatacggctgtaggtgacgaaggtggatttgcgcctaacttaaaatcaaatgaagaagctattcaaacagttattgaagctattgaaaaagcaggttataaaccaggtgtagatgttaaacttgcaatggacgttgctagttcagaattctataaagatggtaaatatgttttaccaggtgaaggaaatagaacttttacttcaaaagagttagttgacttctacggtgaacttgttgaaaaatatccaattatttctatcgaagatggtcttgatcaagatgactgggaaggatggaaatatttaactgaaaaattaggtaaaaaagtacaattagtaggggatgacttctttgtaacaaatacaaaacgtttacaagaaggtattgctaagaaaactgcaaactctatcttaattaaagttaaccaaattggtactttaactgaaacattggaagctattcaaatggctcaaaaagcaaactatactgctgttgtttctcatagatctggtgaaacagaagatacaacaattgctgatattgctgtagctacaaatgctggacaaattaaaactggttctgcatcaagaacagaccgtattgctaaatacaatcaattattaagaattgaagatgaattaggaaaacaaagcttatatggtggcgttgattcattctatcaattagataaataattttgctattaaaagataatgttgttatatccctttaacgattaaatcgtaacttcccaattttagactaaatcatataatgaaatattatcttttaataatatagataagaaaaggtgatgcaagtcatctttttttgcaaataacctaactaaagataaatattggtgataacacctaataatgtcagtctaacttttgtaatagaaagcttaccattttgatttgttctatcatatagtcaagaggtgggaagctatggaaaataaaatgtttaatgatattattgattcaattattaataatgcaagtgatgatgaaattgaaattattagagaaaaaattaataatcacttgatcaatcacatctacgattcaaatattcatgaagaactatcaaacaactatgatagttctttttgtcctcattgccaaagtaaacatatcattaaatatggcaaggataataaaggcaatcaaagatatttgtgtaaagaatgttcaaaaacattttcttctattactggttcattgctttcatacactaaaaagcaaccttatcaatggtttgaatatattcaatctttatttaatggtgatactcttgctcgttctgctgatatcgctggaataagtgaaccaacctctcttgtatggagacataaaatactaagtgttcttgcggatttgactcatgataaccctgttttaagtgatacggtttatttggatgaaaaactaaatgtcgttatacatccaggcaaacatatggaaaacaaagaaaaacaaaaaagagggatgagcagtcaaaaaagaaatatcgtatgtgccatagatcaacataacaataaagtaatccaagtatctgaaacaggaagaattcattccaaagagctctataaaatatataaagataagattccaagtacatgtcaagttgtaagtgacagcttgaggtcatatcataaattgatgaaagatttaagagttaaatgaatcaagataccatcaggtaaaaaagagaaagatggttatacccttaaaaagataaatgatttacattcatcgatagatttatttctatataagtatcgaggaatatcagataaatatttaagaaattatatagggctttataaatataaagatcaacataataaatattatcaaaagaagatatttcttcatatattcaaagagataggcaacagcttatgtgcattgaaattcagtaattttaaatatgattctaaatttttcactatttgattagtttttcaagagatacttaccaacatttatctttagttaagtttttgtaaataaattacatcgtttattgtaccgaaaaggaattaatgaaaattactctctaaatcttttaaaaaggtgtacaatttctatcctatatataaaataaagattgtcatttatttaataaattaaataccttccgtatttttttgactacttataaaatgacacgaaaatcatttgttttaacaaatgatttttttctttatgtttttgtaaataaattacacgatttttttaaagaaaaaagaatgctgtaaataaaaaacaaaaaccattgtaagcctttaacaaagaaaaatgtcacgttatgataatcatgtcaaaattaattaagggaggaaaaaattatggacaaaatggcagatgtcttaggtcgtgctggtgcatggtgcggtcaaaacaaatatttatctgcaattaaaaatgcgttcccttaatctagcgaaaaatatgctaaataaaaaagggtttcaagatagaagaagccttttttttacgctaaaacccgcatgaaatcaacgtttttttgatttgcgggttttcagcttttatgaataaaataatgcttaaaactgccctaaaaatgggctataccaaaaaaattaaaaaaaagtgcaaaattttcatcaaaatgttataaaaaaataaaataactatgtagaaaggactacgtagttattttgttttttaatactgttatcttatttttcttaaaacagatataccaattatgataatgcttgttaaaaaactgtggttattatcattaaaaatcaatgagttaattagcaaaatgattgctataaatataaataagtaatagattacattagtgatatcaaattttttcatattctcactatttatttaattttcggtaattgttgtttcaatttcataaataatagaatttttttgttcctgtatgtaatcataccatagaacactaaagaaaattgctaaaattgtgcaaattactgaaaagaatataagaaatttttgtataattgattttaatttcattcttttaataagattattttcatcactgttttgtatgtaattcacaacaatatctttaggctctccaaattgttgaacaatatcatcatatgaacattgtgggtgatcatctaaatattcatttaaatgtttttttaattcatttaaatagaatttttcttttttagtatgcataggcataattgtccaaatgttcttaatgtatttttttatattattcataagctcctcccaaagattctttaataacgttgtgaattccgtcaacagcattattaaactcattaatcatttctaataatttttcttttcctttttcttctatgtgataataaactcttaccttacgttcgattactttttcataacttgaaatataattctcatcctgtaatttatacaagataggatacatagtaccttctttaatatctattaactcgtgagaatataatttaatttgttttgtaatttcataaccataacaatcttgtttggcaattatacatagaagtaacaatgattacaacatcattttagcttgttcattcttatatgctgcaatgtacattttcatgatgttaattattgatatttcttatggaattattgatccaagaattagattaggaaaggatgattaataatggatttagaaaagattgaatttttaccagacgattttgaattcgttggagataaacaagacattactaaagacgttgttgctccatcacttcctgcttggaaagattctttaaatcgttttaaaaagaataaaggtgccgttattggtttaatttgtattttagttatcgcagtatttgcaatttttgcaccaatgttttcatcttataaatttgatgcaatcaatacaaaaattgcaagtatttcgccatgtgctgaacatttctttggtacagacacttatgggcgtgatttatttgtacgtgtttggacaggtacaagatattcattatttattgctgtagtcgcaatcttcattgacgtgattgtaggtatgacatatggacttatctctggttatttcggaggtaaagttgattcagtaatgcaaagaattcaagaaatcataaactctatcccaactttagtaatattaacattgttattaatggtgatgaaagcatcattattcacaattatcatggctttatcatttactgaatggattggtatgtcacgtattacaagagctcaagttttaagagtaaaagaagaagaattcgttttagcttcacgtactttaggagctagtaacttatttattatctttaaagaaattttaccaaatatttatagtcaaatgattattatgattatgatgtctattccaaatgcaattttctatgaagcatacttatcattcgttggtttaggtttaccaattccaatggcttcattaggtacattgattaatgatggatttaactcaattactatctacccttacatgatggtaattccagttattattttctctatcttaatgttaagtttcaacttatttggtgatggacttcgtgatgcacttgatccaactatgaaggagatgtaattatggcagaaagagaaaaaatattagaagtcagagatttaaatatctcttttaaaactgatagtggaactgttaatgcaattcgtggtgttaacttagatttatatagaggtgaaacaatcgctatcgttggtgaatctggatcaggtaagtcagttactactaaagcaattatgggtatcatggctggaaatggttcaattgatggtggttctattaactacacttggacagatgaaaatacaggtgaaagaatcacaaaagacatttgtcaattaagtgaaaaagaaatgcaaagtgaaattcgtggtcgtaaaattgccatggttttccaagatccaatgacatcattaaaccctacaatgacaattggaaatcaaattatggaaccaatgattcatcattacaatacaccaaaagaagaagcttataaaaaagctgttgaattattacaattagtaggtattacaaatgctgaaaaacgtatgaaaaactatcctcaccaattatctggtggtatgagacaaagaattgttatcgcaattgctttatcttgtgacccatatgtcttaatttgtgacgaacctacaactgcattggatgttactatccaagctaaaattcttgaattaattcaagatattcaaaagaaaaaagatttatcagttatttatatcacacatgacttaggtgttgttgctaaagtagctgattatgtaaatgttatgtacgctggtaaaatcgtagaaactggaacaattgatgaaattttctatgatccacgtcatccatatacttggggattactttcatctatgcctgatttagatacagatgatgatgaattatatacaatcccaggtactccaccaaacttagcacatgaagtaaaaggtgatgcttttgctccacgtaataagtatgctttaaatattgacttaagaattgaacctccaatgtttaaagtacctggtagtacaactcataaagttgcttcatggttaatgcatgaaaaagctccaaaagttgaaatgccagttgaattaaaaaacagattagaaaaaatgaaaaaggagggtgttgaataatggaaaagaaagaacctatccttgtcgttaaagatttaaaacaacattttaaaattaatcgaaactttactgtaaaagcagttgatggtatttcatttgatattatgccaggtgaaacttatggtttagtaggtgaatctggttcaggtaaatcaactactggtagaagtattattcgtttatataaaccaacttctggatcaattgttttcaacggaaaagaaattggtggaaaattaaataaggaaacatctaaagaattacatacaaagatgcaaatgattttccaagatccaatggcttgtttaaatccaagaaagaaagttattgatatcattggtcaaggtttagatattcataaatcttattcttctattgaagaaagaaatgaaaaaatttatgaaatgcttgaacttgttggtttatcaagagaacatgcttcacgttatccacatcaattctcaggtggacaaagacaacgtattggtattgccagagctttaattatgaatcctgatttaattattgctgatgaagctatttcagcgttagacgtttctattcaagcgcaagttgttaacttaatgaaaaagattcaaaaagaaacaggaattgcttatttattcattgctcatgacttatcaatggttaaatatattagtgataagattggggtattacacctaggacatttagtagaaacaggaactactgaagaaatctttgataacccaattcatccatatacaaaatcattattaagtgcaattcctcatccaaatccacgtgtagagaaagtgcgtaaatcatttacttatgattataaagaaagtggagtggattatacaaaaggtactgaacatttagtagatggaactcattatgttttagctactgatgaagaatttgaaaaatggacaaaaaaatagtttaggaggcacttaagaaggcaacctaaaatattataagaaaatattcaaaaaaagagaacaaatgcgaaatgttgttctctttttatataaataaaaaatattacaaaataaaaaggctgttatgaaattatttattgaatttcgtaacaaccttttttgataatttctttcaatttttattaataataattgtgaaattgaaagcttttttcgatttgattgtaaacgcttacagaagattgacttacaagttgttgttaattatgatgaagatgtcttctagataagaagataattaatttttatcttttaaccggtgaaaagaggaaatatgatgattattgacaaaatgaaaatattagaccatttaacaattcaagaaaagtatttagtggattatataataaataatcaagaagatattttaaaaaagaatattaatgaactggcaaaattaagttataccagtagtgcaacaatttctaggttgtgtaagaaactgggctttaatggatataaagaatttaaatatcaatatgcagctgaatattctcatttacttgaattgaaaaatgattttaaaattgaacctttttcaagtgagagttcaattgatgatgctttaaataaaatcgaacttttacataaaagagcgatagagtatacaaaaagtttactagatagacaagttatagaaagaatttatcaacttattaaaaatgctaaatatattgaaatttatggaactggtattaatttttctttagcagaaatttatagtttaaattttgaagaagaaggggttatttctaaagcatataacagtttaaatccaatgcatcttcaatacttaaagcaaagaaaaccaaatgatacagtttgcatttatttaacacatacaggtcaaaataaggaaatgttaaaaatagcaaaggatattcgcaaatttcatgctaaatcaattgtgatttgtgatcataaaaaaagagaaatttgtaaatattgtgatgaaacaattgtaattatgaccactcaaaatacaactgaactatctaatgctgtttatattgcttctttacagtatgtttttaatatatttacttcgttaaaattgataagtaattattcttatttagaagaaacaacgaaagctgttgataaatttaaaatgggagaatgattatgaataaaagttttctatggggtggtgctgttgctgctaatcaatacgaaggtggctatcaagaaggacataaaggattaagtgtaaccgatgttatgtcagctggtgatgttgatcaccctcgagaaatttcttatgaaatattagatgataaatattatcctaaccattatggaattgatttttatcatcattataaagaagatattaaattatttgctgaaatgggctttaaatgtttccgtttaagtatttcatggccacggatctatcctcaaggtgacgaattagagcctaatgaagaagggctagagtattatgatcatatttttgatgaatgtttaaaatatggaatagaacctattgttactttatctcattttgaaatgcctctttatttagcaaaaaaatatggtggttggagaaatagacaattaattacattctttgaaagatatgcgattacatgttttaaaagatatagcaaaaaggtcaaatattggatgacatttaatgaaattaataatcttatagataccgataatccttttaatgcttggactggagcaggtgttttatatgaagataatgaaaatattgaacaaacaatgtatcaaatatctcattatcagtttgttgcaagtgctagagcagttcaaagagccaaagaaattaatgcctctatgcaagtaggttgcatgttgcattttggcccaatttatccttcttcttgtaatccacaagatattcttgcaggaattaaagcaatggataagaggtatttctttagtgatgttcatgtaaggggatattatccaacatatactttaaaaaagtgggaaaggagtaatattcaattagatataactgatgaagatttaaaagatttaaaacgaggtactgtggattatatagggtttagttattataaatcaacgattgcagaatatgataaaatacatgactttattgaagtacaaaatccattgttaaagaaaagtgattggggttgggctattgaccctacaggattaaggattattttaaatgaagtttatgaaagatatcaaaaaccaatgtttattgttgaaaatggttttggagcttatgataaattagaaaatggaatcattaatgatgattatcgtattgattacttaagaaaccatatttcagaaatgaaaaaagcaattgagttagatggtgtagaagtcatgggatatactccttggtcagcaatcgatattgtaagtgcttctactggtgaattggcaaaaagatatggatttatctatgttgatttagatgaccaagctaaaggtagtggaagaagatatcgaaaagcttcttttgaatggtataaaagagttatttcatcaaatggtgaaattttataggagataaataatatgaacaaatttataaatgaaacattagttatttatatatcgaagtttacaaatacaaaagttataaaggctttaaaggatggaatgatgttttctttaccgtttttaatgataggatcattgttcctgttgattgccaacttaccaattgaatcagtaagtaaagtaattagtgaaagtggaataggagatgtatgttctcaagtatattcttctacgttttcattaatggccttctttacagtaataggaattacttattcttatttgaagaatgatcaagtaataacagctataaatggcgctttaactggtttagcagcttttattttattaactccatcttctaaggtattagacagtggggaatcagttacaggaattatttctaaagattggactgctggtcaaggaatgatttgtgctattttaattggttttttagttggatatatttattctttatgtgtaaaaaaagatattagcattaaaatgccagatggtgtgcctagtggtgttgcagattcattttcgtcactattaccaactggaattattattactatttgtgcaattatttatgctatatgtcactttatatttaatacaacatttgcagaacttatttattcggtaattcaaattcctttacaaggaattacagattcgttctttggcgttattattatgacggttgttatgtctttattatggtggacaggcgtccatggtggttctatatgtggaggaattctttcaccaattttacaagcaaatatggcagctaatcaaaaaattatagattcaggattgcctcttacaattcaaaatggtggacatatttttacacaacaattttgggacaatttcttatgtatgtctggtgctggaattgtgattgggttagtgatttatattacattttttgccaaatcaaagtcattacgtagcttaggtaaattatccattgtacctaatatctttaacattaatgaaccaattatttttgggacaccaattgtacttaatatatatttattaattccatttgttcttgttcctttaattataggtataagtagctacttattaatgtatatgggaattttaccattatttagcggggttatggttccttggacaacaccaccaattatatcaggacttttgattggtggatggcgtgtcgcattatggcaatttgtgatgattgttgtatcttttgttatttatttaccatttattaaaaaaatagatactttggaattaaataaagaaaatcaaaagtaacttataagaaatacaaatatttaatcttaatatcaaaaagtcgtgaaaaatcacggcttttttttgtaatgctattaagttaatacttttgctttatttattgtttaagaaatctacacgatttttgttactgcttatttagaagcagtgctttttaaaatatgaagtaagatttgaacttgtttttccatcattgttaaggaacaatattcataaggtccatgatagttaaaaccacctgttcctagattaggacaaggaagtcccataaatgttaaacgtgcaccatctgtaccaccacgaattggtgaacaataagcatccaaaccattttctttaatggcagctaaagcttgttcaacaataaacatatgatcttttaaagcttctttcatatttaagtagctttcagtaattgttaaatcaataatttgataaccatattttttatttaagaattcaacaatgtcaataaattcttgacattgtttttttgcttgttgtaagtcatgatttcgaattatataatccattgttgtttcttcacaagttccttgaatagcatgaagatgattgaaaccttcatagccttcagtagattcaggacgcatatgaactggtaataatgaatcaaattcataagcaacacgtgtagaattaatcattttatttttagcacttccaggatgaatacttctaccatgaatattcacttttgctgaaaaagcattaaagttttcatattcaacaatgtgaatatctcctccatcaattgtataggcataatcagcattaaagtatttcacatcaaaatgattacttccacaaccaatttcttcatctggtgtaaaagcaatttggatatcattatgtttaaattcaggatgtgtgtgtagatactcaaccatttgcataatgatagcaattcctgctttatcatcagctcctaataaagttgttccatctgtagtaattaaatcatgatgaataagatgtaagagttgaggatattgttcagggtctagataaagttttttatcttcatttaaagtaattttttgaccttgataatctttgataatttgtggatgaatatctttaccacttgcatcaggagaagtatccatgtgggcaataaaacctataacatctccttgatgattattattactaggaattgttccataaacaacaccatattcatctatttttgcgttttcaattcctaatgattgaagttcttcaacaagatattttcctaattttaattgttttgatgttgaaggaactgtttgtgaattttcaacagattgtgtatcaaaactgacgtaatttaaaaatctttctttaatttccatttgtcttcctcactttcttcattattatacaacgaaaaactataaacttctatgaaatactttacaaatcaaaaaatgtatgttaccatacaattcgtagccgaacaatataggaggagttatatgtatagagatccaattggacatcgtattaagactctaaataatcttatgagaaaaacaatggataagcagacgggacgtcctgatcgtgcaacattaatgcattgttggattattggttttgttgaagaaagagagtatataggtcttgatacatttcctaaagatatagaaaaagaattttcaattaatcgttctacaacatcagaaatgttgaaattgatgtgtaaaaatggaatgattacaagagaagaagtggattatgatgcaagattaaagaagattgttttaacagaagcttcaaggcaacacaatcgtaatattgaagataagatgagaaaaatgcatcaacaattaattaaagatttatctgatgatgaaattaatgcatttattaaaatttcagataagttaattaataacattaaagaaggtttataaatattcataagttcggtaatgaataggaaaggaagtaaattatggtcaaaactttaatgaaacaaattaaagaatataaaaaagattctttacttacaatgttatttgcaacattagaagttgttttagaaattatgattcctttacttatggcaagtttaattgataaaggaattgaagcgggaaacatgtcaaatgtcacaaaatatggggctttgatgtttgttattgcccttggaacattatctctcggttttttagcaggaaatcacgcagcaaaagcttctacaggatttgctgctaatttaagagatgcgatgtatactaatattcaaacatactcattttcaaatattgataaatacagtacagctggacttgtaacacgtcttacaacagatgttacaaatgtacaaaatgcctatcaaatgattattcgtatgtgtattcgtgcaccaatgaatcttatttgtgcccttgcaatggcgatgatgatcaactttaaattaagtatgattttcgttgtagcgattgttttcttagtagctgtgcttgtaacaattatgtatcatgctacaaaatactttaatgatgtttttcctaaatatgatactttaaatgaaagtgttcaagaaaacgttgtaggtattcgtgttgttaaatcttttgttagagaaaaatatgaaaatgaaaaatttagaaaagcagcacaaaatatttataaattatttgttaaagcagaatctgttttatcttataataacccagcaatgttaattgctgtctatggttcaattttaatgctttcatggttaggtgctaaagcgattgtaggaggaacccttacaacaggtgaacttacaagtttatttagttatgtaatgaacattatgatgtcattaatgatgctttcaatggcatttgttatgattacaatgtcacttgcttcaggaagacgtattgctgaagttattaatgaacaatctgatttagtatctcctcaagaagctttaactgaagtaaaagatggttcaattgatttcaatcatgttgttttttcttataaacatggtagtggagaagctgttttaaaagatgtagatctacatatcaaaagtggtgaaacaattggagttattggtggtactggaagtgctaaaagtagtttggtcaaccttatttctcgtttatatgatgttgacgaaggtagcgttgttgttggtggacaagatgtacgtaattatgaccttgaagttttaagagatgaagtttctgttgtcttacaaaagaacgttttatttagtggaacaatcttacaaaacttacgttggggtaatgaaaatgccacagaagaagaatgtaaagaagcttgtcgtttagcttgtgctgatgagtttattgatcgttttgaagattgttataatacgtatattgaacaaggtggttcaaatgtatctggtggacaaaaacaacgtttatgtattgcaagagcattacttaaaaatcctaaaatcttaattttagatgattcaacaagtgcagttgatactgctacagatgcaagtattcaagaatcatttaatgaacgtatccctgatacaactaaaattattatctctcaacgtatttcatcagtacaaaatgcaagtcgtattattgttttaaatgatggagtagttgatggatttgatacacatgaaaatttattagaaacaaatgaaatttatcgtacaatttatgaaacacaaatgaaaggaaaggaggaaaaataatgaaagaaggaacaatgaaacgtttacttaagatgttatggagtaaatataagattcatttaattgttgttgttttatgtattattggaaatgctttatttaatgttcaaggaacaatgtttatgcaaacattgattgatgattatattgttcctttattaaagagctcttctcctgattttagtggattattacatgctttaattcgtgtagcttgtttatatgcttgtggggttgtatgtgcctttacctttaaccgtattatggtttatgtaacacaagggttcttaagagatttaagaattgatatgtttgaacatatggaatctttaccaattcgttattttgacagaactcctcatggagatacaatgtcagtctatacaaatgatattgataccttaagacaattgatttctcaatcaattcctcaacttatttcaagttgtatgacaattgtgacaacatttgtctcaatgattatcttaaatattcctttaactgtattaagtgtatgtatgttaatggtaatgcttgtagtttcaagaaaacttggttctttatcaggaaaattcttcgttaaacaacaaaatgatttaggtaaagttaatggctatattgaagaaatgatttcaggtcaaaaagttgttaaagtgttcaatcacgaagaacaagctattgctgattttagaaaattaaatgatgaattaagagaaagtgcttatcaagctcataaatttgctaatattttaatgcctgttacggttcaattaggaaatgtttcttatattatttgtgccatcgtaggagcaattcttgctttaaatggacatttctcacttacaattgggacacttgttgctttcttaacacttaataaaagctttaatcaaccaattggacaaatttctcaacaaatcaatgctgtagcgatggcacaagcaggtgcaggacgtatttttgatttattagatcaagaaagtgaagacgatcaaggtgttgtgactttatgtcgtgtagaaactgttgatggaaaaatggttgaaacagataaaagaactggacattgggcttggaaacatccacgcaaggatggacaagttgaacttgtagaaatgaaaggtgatattcgtttagaaggtgttgattttggttattttgatgatcgtatggttttacacaatgttgatgtttatgctaatcctggtgaaaagatagcctttgttggagcaacaggtgcaggtaaaacaacgattactaacctaattaatcgtttctatgatattcaaaaaggatcaattacttatgatggtattgatattaaattgattaaaaaagatgatttaagaagatcattaggtgtggtattacaagatacacatttatttactggaacagttatggataatattcgctatggtcgtcttgatgctacggatgaagaatgtattgaggcagcaaaacttgctaatgctgatttatttgtaaaacatttaccagagggttatcaaacaatgcttacaggagatggagctaatttatctcaaggacaaagacaattattagcgattgcccgtgctgctgttgctaatccaccagcattgattttagatgaagcaacttcatcgattgattctcgtacagaaaaacttgtacaagatggtatggataaattaatgcatggtagaacaactttagttattgcccatcgtttatcaacgattaaaaatagtgattgtattatggttttagaacaaggtcatattattgaaagaggaaatcatcaatcattgattaaagaaaaaggtaaatattatcaattatatacaggagctattgaaatggattaatccatcaatagctttttctttggactaaacgtccattgaaagaagaaaaattgaaagataaaataagtataagaaatgagacatttgtgagacaaatttgagacaaatgatcttgctttgattgttacatctcagttcagcatgaatgtcttggatcatagcctgtttatttttactgatttttcaccaagttacatttggcttcgtaggattataatgtctgtttaatagattttttagtttgtcagagaaatcatgattaatcgttgtttgaatatatggcttaatatattttgccttgagattgttttccttcatgatcgagtaaacataattttgacttaccttgtcaccctttttgttcagtagttctgttatttttggtgatccatatatttcatgcgattccttatgggttttcttttgcttttcttccttgactgctttataaatatctgttttgtttattttcccagtatgccaatagccttttttaacacttctaacgcatcttgtgtatcttttaattcttttcttaatcttgcaatttctttagcctcatcactagaaaaattaccagatcctcgagactcaattttattgccatttttatttgcatcttttatccatttatgaattgtactatctgcaataccaaaacttttagcaatagaaactttggattcttcaggatgttggttagcataatctacaactccttgtttaaattcatcatcaaatactggttttgtcatagtctttctccatttctttttttacttatgacattgtaccaaatgatgtttaattcttctatttaacttgtacagtttttatactaacatcaatatttatattattatactgtggtttggaaaaataaaaaattgtatttcatcaacgtttcataaatggtgtgtataatattattgaaagtagttataaaaggcttttgtttaaaaaataaaagaggaataaaggaggataaaattatggaaaaaaagtagccagaggtgcattcctattacttacgttatgtttgagcttaagtacagttgggtgtaaaaaaagtaatgaaagcaataaaattaaagaaggacaatcaataagttctgaagagaagggtacgtcaactaacaaaaaggataaaaatgcaacatttaagccgtcagattatactttaaaaacaaaaaaagaatatgtttatgaatatttaggccttaaatttaaactttcaaataaatttaaaaagtatatgaatgataaaaagatagcgatgttagatgatcaaagtcctataaataaggaattaaaatatgcttttttaacttttaataaaatgactaaagagcaaaaaaaagcagttgttgataaaaaggaaggtggttatgaaaaatgggaaaatgggcttaaaagaattggaactattggtatatttgaaaaaaatacagcagaagaaaaaatatctaaaatgacaaaatgtgatactcatactaaaataggagtttcaagtgatggaaaatacgattgctattttagtacgaacagcgaatctgaaattaaacttctgaatgaatttaaaaaaactgagattcaaattatagaaaaaaaagaacgtcctaaaaacggttttgttctatcagaaaaaactgatttagaaaatacagaagcatttaaaaaataatcagttaggaatttacgtaaactattactaaaagacataaatggttaggattttacaagtaaatattttgagaagtatggtaaacgtatttacaatttagcgtaaagtttgtgtaaaagagatttcaaatttagttgaggtttagaacaaaataaaaattaaatgttttaatattgttagtgttgttacagataatgttgatgataatggtgaaaacaagggagtaattgaaaaagaattaacaaaaataaaaaataagtaaatgtaaagcggtgaaaggtatatggttaattagttttaaaaaggccgtactttctctttagtaattgtctttattaatatgactgtgacttactatggatatagtcatggagcgactagagttgaattggagaaggcaataagaatttgcttggagtgtgttggaattggatagaattaaaaaaattgagacatttaagcttgataagaatttgagaaaattgaaatatataatattgattgtatttgtaataatacttcctctatttttagttgatattttaggacaagggtctccatatttttgtaagcttattagtccaattggtatgcttggactttggaagctatttattcagttattagcccaatttcagtattcaggcatagactagacgaagaaaagtgcatcagttgcggtaatgtgaaaaagtttgctaaatgaatatagatccagttgaaaattgtaatcatctagaatgtatcagatgtggacgatgcaaaaatgcatacaattagttgtggaataaaaaaatagagaggagcttattagaaaagtgataaaaaacgcaatagcatacattacaagaaaaaaaaatagaacatttattatttttgttattttaacaatagttctttcttgtttgtattcttgtttaacaataatgaaatcaagcaatgaaatagaaaagactttatacgaaagttctaattcttcaatatcaataacaaaaaaagatggtaaatattttaatgttaatcaatttaaggatattgaaaaattaaaagaaattgaagaaacaataattcaatatgatggattagcaaaactaaaagatgctaaagtaattagcggggaacaaaaaataaatagagaagatttatctgacgaatttaagaatgttgtttcactcgaagctacaaataatactaaaagaaatattttatttagtagtggagtatttacaattaaagaaggtaaaaatataggagaaaatgataagaattcaattattgttcatgaagaatttgctaaacaaaacaatctaaaattaggtgatgaagttgatcttgaattactagatattgaaaaaagtggaaaaataaaaagtcataaatttaaaattataggtatcttttctggcaaaaaacaggaaacatatacaggattatcttctgattttagtgaaaatatggtatttgtagattattcaacaagccaagagatattaaataaatcagaaaataataaaatcgcaaataaaattttaatgtattctggtagtgcagaatctacagacttagccttaaacaaattgaaagagtttaaaattgatgagtcaaagtattttgttgaaaaagattctaatgcgtttgaagagtctttagagtcagtgagtggaataaaacatataataaaaataatgacttattctattatgttaggtgggatggttgttctttcgttaatcttgattctatggttaagagaaagaatttatgaaataggtatatttttatctattggaacatctaagatacaaattataatgcaatttatattcgagttaatattcatatcgataccaagtataatatcttccttatttttaggaaatgtattactaaaagtaattgtagatggattcattaactcagaggattcaataatttccggtggaagtttaataaataatagtggttttatgttaaatatagtagcacttggacaaagttatttgatattaataagtattattgttttatcagttgtatttgcttcttcattaatattaatcaagaagcctaaagaaatattatcaaaaataagttaggagaaaataatggatatattagaaataaagaatgtagcatatagttatgaaaattctaaagaaaaagttttgtcaggagtagatcaaaaatttgaacttgggaagttttatgcgatcgtaggaaagtcagggacaggaaaaactacacttctttccttactcgctggacttgataaacctaaaacaggaaaaatattgtttaagaatgaagatatacaaaagaaaggatataacaatcatagaaaaaataatatatctttagtatttcaaaactacaatttaatagattatttaacaccgattgaaaatattagattagtaaacaaatcagcagatgaaagtatcttgtttgaactaggtttagataaaaaacaaataaaaagaaatgttatgaaattatctggtggacagcaacaaagagtagctattgctagagcattggtatcaaatgcgccaataatactagctgatgaacctactggtaatttagacagtgttactgctggagaaataattgatatattaaagacgttggctaaagacaaaaataaatgtgtaatagttgtaacacatagtaaggaagtagcagattctgcggatatcattttagaactaagtggtaaaaatttgaaaaaagtaaataaaatgaatttggaggttgaataatgataaaaaatgcatttgcttatgtaactagaaaaagcttaaaatcattaattattatgttagttattttatctatgtcaattttaagttttattagtttatctcttaaagatgctacggacagagcttcaaaagaaacattggctaatataacaaatagtttttctatggagataaatagacaagtaaatccaggaacacctagaggtgggggaaatgtaaaaggtgaagatattaaaaagatatctcaaacagatagtatagactcctatgtaaaaagaataaacagtgttgcagatttagttgattatgatattattgaaactcaagagactcttgcgaatcaatcgcctgaaagagcgaataatttcaaaagaacagttatgttaactggggttaatgactcatcaaaagaaacaaaatttgtatcagaagcatataaattagtagaaggaaagcatttagaaaatgaagataaaaataaaatcttaatgcataaagatttagctaaaaaaaataatcttaaagttggagataagataaaattaaaatctaatttatttgacgctgataatgaaaaaggtgcagatgaaacagtagaagtagaaattaaaggtctattcgatgggcataatagtggtggagtaagtgcagcacaggaactatacgaaaatacattaatcactgatattgatacggccgctaaagtttatggtaatacagaagatacagctgtataccaagatgcaacattctttgtaaaaggtgataagaatcttgatagtgtgataaaagaccttgggaaattagatataaattggagagaatataatttgattaaaagttcatcaaattaccctgcattacaacaatctatatcaggtatctactcaatttcaaataaattatttgttggctcattaatatttgcaggaattgtagtttcattattattattcttatggatgaatgctagaaagaaagaaatagcagtattactatcattaggtatatcaaaattagaaatttttggtcaattcctaattgagatggtatttatatcaatccccgcattcgttggttcttatttcttagctcaatatacagctgataagcttgggaataatatattgaataaggttactggtgatatagctaaacaaatagctagacaagctgcatctagccaattaggtggtggggcagaagctgaagggtttaataagacattatcaagtttagatataaatgtattacctaaattcataatttatgtagttatatttatgagtttagtacttcttgtatcattgattatttcttcattcgatatattaagaaggaatccaaaagaattattaattgacaataattaaaaattttggtgctttctagcaccgaaatttttttgacttttaaatatcaaataatatgctgtataatataagtgtataggcttaagtggaggtatttatgaaaatattaattgttgaagatgataatatgatcagagagggaataagtgaatatcttttggaatttggatatactgttattcaagctaaagatggaatagaagctttgtcaaaatttaataacgctataaatttggttatcttagatattcagataccttttataaatggtttagaagtgttgaaagaaattagaaagaaaagcaatttaccaattctaatcttgactgcatttagtgatgaagaatataaaattgatgcatttactaatttagcagatggatatgtagaaaagccattttcattgccagtcttaaaggttagaatagattctttgattaagaagaattatggacatttagagaagtttgaatataaggatttatcggttaactttaatagctatacagctaaaataaatgatgaagaaatagatgtaaatgcaaaagaactagatgtattaaagtgtctattggataataatggacaagtattaactagaatgcaaattattgattatgtatggaaagatagcgaagaaattccttacgatcgagtaatagacgtatacataaaagaacttagaaaaaaattgcaattagactgcataaccactataaggaatgtgggatataaattggagataaaatgagaaaatgaaaaaattaaagatatttcccaaaatgttcatacaaatattttctgttcttggaataataattatattagttcatttattagttttctttatttttcctaaaacatatttggagaccagaaaagaagaggtctataataaagcaaatgaaatttccagtattatgaatggaaaagaaataaaatatatagaacaaaccttggaactttattctaaaagtagcgaaataaaggcatttataaaagaaagaaataataataataatgaaatacaaatcaaagataatatagatgctaatttagaaagtaatagtaattctttgataattgaagaaagagaaataaagcttaatgatggtaaaaaaacatatctacaatttgtctctacagctgatatgcaaaaagatgcaaaagatttaagtcttaaatttttaccatattctttgttaatatcaattttattttctactattatttctttaatttatgcaaaattaataaaaaacaatgtacaagaaatacaaattgttactgataaaatgatgaaacttgataaaaaaatacgtttagaagttagctctaatgatgaagttggagaattaaaacaacaaattaatgatttgtattctactttattaagaacaattgacgatttagaatttaaaaataaagaaattttaaaattagaaaagttaaaatatgacttttttaaaggtgcatcccatgagcttaaaactcctcttgctagtcttaaaataatactggaaaacatgaaatacaatattggaaaatataaagaaagagatatttatattaatgaatgtattgaaatcgttgatagtttaacaaaaaatatttctcaaatattatcagttcattctatagaaaatttgaataatgatgaagaatatttgaaaataaatgatacattagaagatgtattaaaaaagtatgaaatattagcacatcaaaagaaaataactatcaataattatatattagatgagaatgtttatataggaaaaacagctttaaagattattttatctaatttgattagtaatgcggtaaaatatactgatgtaaatggggtaattaatattgggatggttaatgattggttatatatagaaaattcatacggtaacaataaaatttcgaatatggatgaaatattcgatgttaaatttgatttaaataaggaaaatagtaatggattaggtttatatattgtaagtaatattctgaataattacaatatagaatataaagcattgcaggatgaagaattttttatctttaaaattaaaatattatcttaagtaagatataattttttaatagttattgaaaaatagagacttattaattgtggaaataaaaacttttttcttattgaaagtgaaaagaaaataattgataaatgattattccactctaattgatcacttattccgattaggttgatcaagtattccgacagacttgatcaactgctatttttcattaaattccgatggggctgatcaatcattatgatgaacctgaccatctaaaagttttggttattagatatcagctaaagcacttatacaaaagtttactaagctattctgtactaataaattgaaaacatagacttgctgagttgaatgttacgctagaaaagtccattcaatacgttgaataagtccactttaccaaaatattgaatatgtttataaagtcaaaaggatttaatatattcttcttgcaataatttctatattaaaaatttgaaagggactgtttattttaatattctcaaaaaattaaatagattaataaaaaatatgggaaaaaacgcataaaattgtatgctatcataccatcaagttataaatagatgtgtccaaaatagtaaagcatttattgtagcttaggtaagctaaactaaatcggttcagtttgctatctaaagtagttaattattaatgaataggtacaaactcgttttttaatacttctttaaatttttattacatataaaccttattcattaaaatatttataggaggtgatacaacacaaaataatgaaagcttttagattttaatagcaatctaaaaagctaccactctataaaacttaatattataaatcgcttgttaatcttagatagagggtagacttataagttaatattctaaaagttaaaaataagattattgttaaagatgtctagataaaaattaattttggtacattgcacaattatagatattatgatccatttaatgattctaactcttaaatttatagacaggtagcattctcaaataaacattaagtgtttaaataacaattcttatttaatattgagtagttgtaaaaaaagaatttaagtagaatgaataatttataaaagaaataatagagtgtatctatgagaatatgatattaggtattttcattttaataataacttcccgaaaaaatattaaaacctcataaaaaaagataattttactgtaaatcatttctatacatgcttaatcattatattttatgcacacataaatacgtacttttataaattggtaacttaattctaagtagtttaaagaattataacttttgattaaaaataaaattcattctcccaaatgaaaaacgtaacaattccgaatcaaattttataattctttttttcatttatataataaggaggcatttatgattcattcagtaaaagattttgtagataaaaaaatgaataataaattaatttgttttaataatgttttagatgattatttatttttttatgatataaaaaaggattctttttgtgctacaaaaagaaataaaaaacatatcgaagatgatcatgtctttttagatgattataaaagtataaaagaaaaaatatattttaaggatagaaatataattgataatttatataacaaaatcattcgtaaagaaattgttttgggaactatttatgaaaaaaacaagttaaaaataaaagaatatattggtgttgaaaacttatttgattcttttaaattaaataatgcaggatttgctttgatgatgaaagtagatcagtatgatgaaattcattttacgacttactataaatatggtgactttgtaaaaagtagtataaaaaaatgtattatttcttctttgaaaaagaaacaaaaatatattgaattggattcatggaattttttaattattgatttagaaggagacgcagaagatgcaaagaatctttttcaatgtattaccaattcaataaatcagttattaaatgataagaaacaaaaaatctatttttcaatagctgcaggagctattgaattgagtaaagaattttattcttatgacagagtgttagagtgtttgaatttttctttaaatcgtgcagagggatttaatggaaataagttctatctatttgatatgcaacactatataagattaaaaagaaaagaagaaatattaaaacatatttattgggctattaatcatgattttgaaggtttcgaactttattatcagccgattattgatataaatacaaaatcaataataactttagaagcactattgagattaaaaatgaaagatgagtacattcaaccgaaagaatttatttctttacttgaacaaacacacttaattcttcctgtgggaagatgggttttaaaaacagctatggaaagttggaaagaattgcaacaattgattccaggtctaaaaatgaatgtgaatatgtcatttgtgcaagtaaatcaaaataatagtgttcaaatgattatagatattataaaagaaatagatacaactttattaggaatagaaataacagaaacaggggaattaaattcaaatcaatattataatttttgtatagggctagaaaaagggaaaagagcacttatattagatgattacggatctggattttcaaatgtacatcgtttaacagcggcaaaaccacaatatataaaaattgatcattcatttacaaaacatattataaaatcggattattatcgaaaaatattaaaaaatactattacagatgtaattaaatctttaggcgctgattatatgcaaggttgtttatttgcaagaccaatggataagcattcttttataaaaaatcataaaagaatgagtgaaaatttcttaaataactaaaagaagatatatagggggaaatatgaatttagattttttaaaaaggataacagggggactattcttattaacaacagaatttaacggtataaagaatggttgtattattaataattgtatggaggtttcaacaaatccatcatgtatttctatatcggttatgaaaaatagttatacaaatgaattgatagaaaaaagcaaaaaatttgcgattagtattttaaataaagatgtatcaagtgaaatggtaaagaagtttgaacttttttcaggaagaaaaaatgataagtttcaaaatatttcaacagttatggataaaaataatgttccttatgtaacaaaaaaatgtaagcactgtcataagcgctaatgtaatcagtaaatttgatttaggaacacatacactctttattgcgcaagttattgatatcaatgatatcaataatagtaagcctattacatatgatgaatatcaaaaaaatgtggtattaaaagaaaaaaataaagcatcatctcaacatattataggatggaaatgtcgaagatgtggttatgtacatattggtgaaatactgcctaataattttatttgtcctttatgtggccgaggaaaggatgactttgatcctatatttaaagaggaaatagaaaattgaatttagtagtatattatcaaagtaatggaaaagtagtaaatcacaagtattatattgaagtgattgatcatgatagttgttcatctgttaaatttgatctaattacaaaaagatttatattctttgaaaaaagaagaataagaaaaagagtttatatggaattaaataaatcaaagttacttttagaaagtatggattttaacttatcatgtaatgaaaaattacaatttcctgtattaaaaatatagcaggggtattaaatgagagatgaatgtggtcttagaaagttaaaaatcatataaaaacagctgtgaagagtaaattttttctagctaaaaaatatgataaaatagtagtaaaaagggagaatatggggaaccatgttctcttattttgtaagcgccaaccaaaatctaacgaaaggatatttcatcatgcaaagtataacacatttaatttactccgcctaataatttagagtgaacctctaagcaccggataatttaatataccttaaaagatattgacaatttgttagtatcttttttcttgacaatcttttttataattatataattaccaatgataattaccatcagtaattaataggagaaattaatgaaaagcgaaaaagtaaaagaaatgttagatagctgttacatggctaaaaggattttagatatgttgcctaaacttcctgaaggagttttaccatcctatgtacgttatttagaaacgattatcgaacttgaagaaaaaaatcaaaaagtgaaggtttcagatgtgagtgaagttttaaatcttcctcgtccgggagttacacgtacaattcatgcaatggaagaaaaaggatatttaaaaaaagaaacagctaaacatgatggacgtgtcacttatgtgaccgttacaaaagaaggaaaaatgatttttgaaaaatacaataaagattattttcaaaaattagccttgtgtttgaatcatgtttctaatgatgaagcagattgtatgattcaaactattaaaaagttttatgaagttatgtgtgaagggagagaaaaataatggatcactctaagtcggattttacgcagggaagtattttaaaaaaattatcattatttatgattcccgttttaggagcgcttattttacaagcggcttatggagcggttgatttacttgttgttggaaggtttggaacaacagcaggactttcagcagtttctacaggaagtcaagttttaaacttgataacatttgtggtaacacaatttgcgatgggaattacagttttaattgcaagatatattggtgaaaagaaaatgaattcgattggtgctttaataggaggagcaacggtagtttttgcaattatttctgcaattatatttgtagttatgattacgttagcatcaccaatttcaactttaatgcaatcacctaaagaagcacttggtttaactgctacttatgtaagaatttgtggggcaggtattttctttattgttgcttataatctattatcagcaatctttagaggtttaggcgatagtaaatcacctcttttatttgtggcagttgcctgtgttattaatattattggtgatttagttcttgttgcaggattacacttagatgcagcaggagccgccatggccactgtctttgcccaagcaatcagtgttgtgtttgctttaatgttattatttaaaagaaaattaccatttaaaattacaaagcatgattttaaaatcaatccacattgtgttcaagctttaaaaattggattaccattagcgcttcaagaatgtttaacacaaatttcatttttagctttatgtgcttttattaaccgtttaggattagaagcatcatccggttatggtgttgcttgtaaaatcgttaactttgccatgttagtaccaagttcattaatgcaatcaatggcttcttttgttgcccaaaatgtgggtgctggtgatgaaaaaagagcaaaacatgcaatgtttacaggaatgggtattggcttaataattggtgttgttgtctttatctcagttttatttaaaggagatttacttacaagtatttttacaacagaaaaagccgttattttacaagggtatgcttatttaaaaggatttgctttagaaacaattgtaacagcaatattatttagtatggttggttattttaacggtcattatcaaacagtatgggtcatggtacaaggacttattcaaacacttcttgtacgtttaccactttcttactatatgtcaattcaacctcatgcaaatttaacaaatattggtttagctgcaccaattgcgacaattgttggtattatactaaatgtatgtttctatatttatttaagtaaaaaaatgaaaaaagaaaatgcttaggaagtgtgaaaaacacttcttttttaataagaagaattttttgtgttggagctactgttgccattgctgttgcaattgaagaagctgtaaatattgatgattattttattgctctatctttacaattacactgaaaattaatggattttcagtgtaattgtaaaacaccttttataagtatattagatgaaataatgctgaatacgttttaatcagcattatttttatttataaaattttccattaaaaaatctttaaattgttttttatgtacatcattatccgcaatttgaatacgtccaccaaaaccgatgatccatgaataaaatgtactatttataatgtgtcttacttggactatctattttctttttattatgataaaaaacgttgatatatcaatactttcagctgattacatattagttgattttgctttttggcatacttttgacatcttttgttttgaaaacatcgtttacagtatctaatttcttgttttcttttagatgagtatagatatctaaagtagtcttaatattactatgtcttaataattcctgggtagtttttatatctacattattttcatataaagtggaagcaaatgtatgtcttaggtcatgacaagtaaacccatatttattttttaaaatcctattaaaatagctaacataatagaattgattatttttttgacaaatatattcattatgatgcgttttcaaatattccaataatatttcttttaattggttattcaaaggtatagtgtcttttgatttttttgttttcaattttgaaacaactttatattcctttatattccttcctgaatagatcaattgattatgaatgtttatttcattattttcaaaatcaatatcactttctttcaatgctagaatttcagcgattctcatgcctgtataatatccaatagcaatggtaattgcatagctatcatccaactcattatatgcttgaataaaagtttcaaaaggaactatctttttttctttttcttctttttcagcccatttaaatgttacaaggttcatgggtgaactgtctatatattccattttaattgcaaatgaagttacatttttaacgatgtatctgacagttttaactgttgaaaatgtcatttcttctaagctgttgaaaatactttgtaaaaaagcataattgctgaacaagtttattttagaatttccaaacgagttttttatatacttgtcaaatgtaactttctttcttctaattgtgtttaatgataagttttttccttcagattccataaactcttcaaacacatcattaaatgttttatttgttccttgattcaaagtgcctttttcttttaatctagccttcatttcagtctcatgtatctgtgcctctttttttgttaaaaacccacttttagaataatactttcttttgtcaaacatgtctctgtaataaaaataaacttgataagtatatccgttttttgctttttttgcaggtctttttctaatcatatatcacgactcctctcatattttgtataataaaacgcccataacggaaaaaacaggcgtaatatctaatttaaacttctaaacttgtctatcttgaaagcttctatcatttgcatgatgtcagccatatcttcaggggatatctcatgatcaacagcaaatattgaattttcatagacatctatataagaatccagcatatcaggatgattatcataaatgtaatctaggtttttatcgtggttggtatttttcatattattgtttctttagttcaactactttgctgacaccttgcatagaagcggtaaatgaaagaatatcatttttatatgtaaattcttttgtatcatcatttgaagctaatagtgcatttttagttttttcatggtcattattagatacccatgaatattcactattggcagtagtaggagcatcatatgaaccaacccaataagttgcttttgtttttccttcatccgtcacccaatcgatagaaataacgttatcagaaattgtagcttccatccatgtgccctcattttcatctgatttccaagtccctgttaaatttaaaggttctttcttttcttctttttttgttgtagttgtttcttttgaagatgaattgtcttttgaactgctatttccacatgcagttagagatagaactaaagttccaattaatactagacttaataattttttcatttgtttttcctcttttcttaatatttttataatttgaattgataccatatattagctatacttatatcaaggaagggtggtataagtatgaaattaattgcatcatttttttcttcattacttcaaatttttagaaagcaaaccaaattttttataatatatttttgtttactcaatatagctattaaaacgagtaatttgacagttattgttttatgctttgttttatttgctattatgaatattgaaaataaaagttagttatttacatttatttttgtattcaataaattttttataaataacattatcatatagaaaaattccaagaattaacaatataagacgaaaagctatgacaaacataccgttaataatcaaggatacaatttccccaccgattttttggtatatcatggcctttaattcggttgtcattgacttatttccaaatagtagaaattggttgagtacttctgctgcttttacaggatcttttataaaagacatcatttcaaataaaacaggtgggataaaatattttattcttggttctttatattcttcgccatttatttcggctttcatttcagcaacagatatatcatttggaaatggaatgttaaaatcaatatcatcaatttttgatttatcagttttatcagcattgaggatagatcgaattatttctatgtttttgcttaacgagtcgttaattgaagaaaaatcaatatttgatatgaatgatttagatatctcagatatatattcagaagaaatacagatatttgattttttaagtgaatcaatcacatttgaaaaatgtttaaaatcatcggaactagccaaattattattaaacgcttcaactaactgtttggcataatcgtttaacaaaggacctgaaacatcagaaatttgttgttttaaagatgctaaattctcttcaaaaaaagaattataatcatacatatctatatatttttttgataacaatgtttcatcatagctattcttcattcgaattacctcagtattttatttttttgagttttgtttttagtgtttctagtttcttctgataagtttcatcatcaataattcctgctttatgcaatgattcaagttcatcagctttattagagtaatattctatgtttcttgaatcgtattttcttacactatgagcataagctagcagtgcaacacctaaagaaaacattgctatagttataggaaaagtagttttgatgtctttagaaaacacaacgattgctaatgctgttaaaaaaaacaaaattataaaaacttcaaagcatcttgataatttatctattgtttttgtaacggtaattaagaaaccttgcaaaatgcaactgtaaacaaataatgcaataatataaattgatataactgtaaataacgaatttaacgctttcatataaatcactcctttaatcaatcgttattttctcattcaacgaataccacactttaagcggtattcctttttcttttacaataaattcaatattttctagttcttttatattatgtagttcttcatacatcagtaatctaatagcaaattcatttgcttctctttctaaacgagttttatagactcgccttagaaaattaaaactgatgtctttatcaaaatgcagaacatagtgtcccaattcgtgtgctataagaaaattttcatacgcacaatctaaatcacttcttacaaatatgtagcctttagaatcaacaatcatcagtcttgaatctaaagtttttgctttgaaatcttggcattcaattgaaatatcaagatgatctacaagttctttaatgtttgaagtattatattttttaattaaatctttgactttatgttctatattcattcataagcacactccttagatattatttgtgctttctagatataattttcaacatatcagcaatatcatctgccatttccatgatttcatcatcagacatattttctaaatcatacccaccaaaatcggctaccatttcttgttttaaaatgaagcttaaggcttcttgtggagtagagaaagatatgtttgatttagatgcattttcctttggtttgtcgtaaatagacatatcactatcaacatcagttctacacattatgtaatcaagtgttacattgaagaaatttgcaatttttaccattttgtcaatttcaggtgttcgcttattgtttacatattgagagactgttgcttcagaatctgaataaccatacttttcattaaatttttccacaaattctttttgcgaaagtccattcttttttattaatttttttattctatctcccggtctatcataattcatttttaagcctcctaaacaatctttttcttatattaaaattaacattttttataataaaagtaaaaaagattagagcaaacttaacaaatattataatttattattgactttcaatttgtgttaagttactatagtaatgtaaagttaacgcaaacgtaaagagaggtgaaacgatgaatgcaaaaattaacacaaggaaaattaaagcaagacgtgttgagttagacatcaagcaaaaacagatgtctgaaatgcttaaatgctccacggttacttattctaaaaaggaacgtggcattgtagattttgaaggcaaggaattacttatggtttctcaggtattaaagataccaatggaggaactatatattttacccaatacttaacgcaaacgttaattttctatcaagcacaaacatattttaactgatatttaatgaagcttcctaaaaagacactttattaaatgcaagaatttggagtttaagaaaggagcaaagaaaaatggaaaatgttgaacaaagatatccaattaccatggctgttttaagaaatgctgcagatagaattactaattggaaaaacgtaaccccacaagcaaaattaagaaagcgatgtgaaattgcacgtgttgttattgctttatcaaacacgttatagaaaggagagatacacatggaagtcagaccaacaaagatgctcaccgaaaaagaactacgtgaagatttaggaatttcaagagaccagttgcttaactttattgaccttgaaatatttcgtcctatcagattagggcgtggtagaaaattcagtcaacaagaaatcttggaatttcaaagaaagtatgcaggtcttgacgtaagcaattatcacaaggcaaaaaaagctaaagaatatgtagataatttagcttaaaaaaaattaaatagattactggtcatcaaggagccaatctcaaaggcctccgataacaaaatagcattgatgatttactaactacagacataaaaaaagaactaataccatacaagtttttatttaagaggttggttccttgatggctagtaatggaaaggaaaagaaaatttatgagtaaaaattcattaattatcatctgctgtattttgtttgttgtcattgctgttttaatccacatgttaaaggaattcaaatggtatcaaaaatcctactatgaattggcaaataagattgccaaagatagaagagatagaaaaatgctggttcgtgcggatagagaaatgatcaagagtgaaatagataaaaaatttctagcaattcttagaatttctcaaagagaagattatccaagaaatcgttttgaattgggctatgaatcaggaagatttgaagtagaagttaaaaacttatttctatcaggtggccttacaacacatgaggaaaagtttcttaaaaaatgtgagtacattgcaatgtttgaagtgaacgaaaaggaggtgtgatttatgaaactatcagcaagaggtttggccacgattattgttatcggttgttttatcgctaactgtttagcaatcttggtcaggagtatataaaaaaggtgcctatatctaggcacacaacatagcaaataaattctaagtcattaaaggagaaaatgcaatatgaaagtcaaaaaaagaacatattttcttatttcaatattagtgatgttttgtatcattgctccaatctgttactaccaaaacaaattggatgcttataaaacaaaagttcaacaacaaaagggaaagatttctcttttggaagattattacagtaatgctttagccgataagaaccgctttgaagatttatatgatagtgttcaagaggataacaagtatcttatagctcaattagaagaacttcaaaaatgaagaactcttggtcagtttactattacttactactggcccaggagaagatcaatacggtcgtttaacttctacaggtgctattgctgaagaaggaagaactattgcggtagatccttcaatcattccatatggttctatagtcttgattaatggcaatgaatatgtagctcaagactgcggaggagctatcaaaggaaaaaagatagatatctttgttgacaatccgaaaatgcaaaagtacacagtagaaatctatattaaaagagaggaatagaatatgacaaaaaaagatttagaagacatcatccaaaccgcaaaagctgcaggtgcagatgtcaaggttgttcaaattggttcaactgaaaaggaaacaggaacagatgaaagaccagcagtaccattacttaaattagaattaagcatcaagaaagatggagatgcactttcggtattagctgatgctgattggaacatcttaggaagtcttttcttagaaatggctccaatcaatattgacattgaaaaggtcaaagaaatgtttacaccggctaaaaatgctttcatgcattgcagtaatgaattggataactacatccaagaacaatttaaaggagctttagaggatgaaaaagaaagaattagaagaaagagttgctgatttagagagttcaatcatttgcatggaatgtaaggatcatctaaacagtgatgattatcttcaacttggttatctcaatcaggaattagcaagtgctaaaaaggatctagaaaatggaaactacgaactatgaggagttctttcctaattgtaatgtcgattatgtcaaagacaaaaaacattggcatcaattaagaggaaaaggaattggtggttctgatgcaggaattgtaatgaacgtcaataattacaagactccctatgaattgtgggaggaaaagacaggtgttaaaaagcctgtatttcaaacgagtgaagcaatcgaaaaagggaatgcattagaacctgtccttattgaattgttcggtgtgctctataaaaacaagtttgaattagttgatacgaaagatatcagtctttcaaataagaagtatccatttcttagagcaaatcttgatggagcaatgattgagattgcaactaaagaaaaatggggattggaaatcaaatctacaactatccaaaatggcgcaatgttaaaagaatgggccaatgatcacattccaatatgctactacttccaagttttgcattacatgatcacaacaggtcttagacattttgtcctatatgcaattcttgatattccttgggctaacaatggtgcagggaagcaagaaacaagagttgtttatcttcactatgatgatttggtgctagatgctaaatatctattcaaaacggaattgtggtattggaatttaataaaaactaaaactccacctccatttttagaaaacagaaacaaggaattaaaagaagtcagttagaaaggagaacctatatgaatgaactattaaaagtaaattatgacaatgaccgcattacattgtcagcaagagaattacatgagtttttagaagtaaaaacatctttcaaagattggtttcctagaatgtgtgaatatggctttaatgaaagccaagatttcaacccgctcaaaaatgagcaagttcgattagaagggaatcgacaagtaaaaagaactgttcaagattatgaaatcactttagacatggcaaaagaaattgcaatgattcaacgcagtgataaaggaaaagaagtcagacaatacttcttggaattggaaagaagatggaacagtcctgaagcagtaatgaatagagctttggaatattcaagaaagcaagttaaagcgctaatggaagagaacaaggaattgaaaccaaaggcattgtttgctgatgcagtaagtgctagtgatgaatcaattttgattggtcagttagctaaattaatcagacaaaatggctatgagattggtcaaaatcgtttgtttgagtggatgagagaaaacgaatatctaattaaaaagggtgaacgttacaatcagcctactcaaaagtcaatggatcttggattgtttgaagtcaaagaaagaacaattactaatccagatggaagtacaaggattacattgactactaaagtaacaggtaaaggtcaagtgtatttcataaataagtttttatcgtagaagggagaaaaaagaaaatgaatgagtttcaaacagggctactcaatgaattggtagctgtaaaaattacaaccaaagaagaatttgataaagttatcaatttcttatcaatcaataactgctttcttgtgaatggagaaccagtagtcaaattaacatatccaggagataaagcgtttgtcattttaaaacaagacaatgcaatcttctggcaaccagctaatcaagtgttagatgaacgttataaagttgtcagcgttatcgaattctttagaccaactgaagaagaaaaggtcgttgaggccaaagctgaagttattgaagaacacgttgacattgatgaaaaacacctttcattagaagttcaaaaaagaccagcaaatgaagcgattgtttcaaatattgatgaaatggtcaaattgattccagcaattgaagctaagaaaggtgtggttgtagatgaaaagaactacaaagattttgttaaagctaaaactggaatggttccattatatcgttcgtatgctaaaaaattagaaactgaaagaaaagcagtcaaaaaagcatacattgagccttatcaagaatttgaagcaaaggtaaataaagttgttaaagctttaaatgatactgcaagtgttgtggctgaaaatgtggatgtatttgttcaaaagcaaaaagaagctcttagaaaagaacgtcaagcagctattgatcaactaaaagaagtattgatttctagaaagatgatttcaaaggaatatgctgatcagttcgtttttgatgaaaaatggcttaacgcttcaacatccaaaaagaaatttgaagaacaagttgaagcacaattcaatgctttaatggaaaaagaaaagaatgacaaattaaaccttgaaatgattgaaaaaacaatcaccaatgcatgtcttatcgcaaatgttgatgaacaactcatttcaagagaaaaatatcaagctcttttgaatactgagggattaccaaaagtaaccgaaatgattactgatgaagtagacaacatcaaaaagcaatcacaagcggttgctcaacaaaaagaagcagaacttcaacatcaaaaggaagagtttgaaaaacaaaaaattgaatttgaaaagagacaaaaagaaatctatgaacaaaaacatagagaacttgaagctcaacaccaaaaagaaatggaacaagttcaatcacttgcaggaaatcaacctaaatacacaccaatcaagcgtggtgatgaaacgattgctaacgtaaatgataagtatatcgttaccgaaatcaagcaaacgcctgaaaagttccaaggcagaacatggaaaaaaacatttgaattcgagggcgatttagcagcacttcaaatgttgaacagatacatggatgtaatcaaaagcatcaatccatcgtttaactttagtgaagtcaaactaactgaaaaagaattaagtgatcctcaaacgggagtggtcaataaatataacgttaaagaaatcaattaaagaaagttatgaggtgaaattatgaataaggtttatttagataagaatggaaaattattcgttaatggtcatgaaattaagggagttatgtccgtttcatcagaaacagattatctaggtacacaaatagttttaaagtttgaaggtgattacaaatgcgattttatttcatcaagaaaaggacattcattatctgaacgtcctaaggaataaacttagcgataaaatctgtaagttctatcaaaccatttttaaatcttttttccatataaataatagcattatttgtgagaaggaagtcgccacttacccactccttaacaaagccaatggattttaattcatctagaatgtcgccaacatcttcgatattaaaatctaaaatatatggttctcgttgctcaaagttatttttaaattgttttgatctgtctaacgaataaccttgagcacgcctttctagaaatgttttatatgtagaacataagaatttatcagctaattttgttagcactactgacactgtttcacctcactttcgaggtaaattataacactaaacaaaaggagaaaataaattatggcagtacaaagcatggtacaacaagcaaatgaagtaagagaaaataaagtaacaacaatcaaaacagatacaggagaaatcaagctatcttctaaaatcgtaaaggcttatttggtcgctggaggaggtaatgtaagtgatcaagaagtcaaactattcattgcattatgttcagctcaaaaattaaatccattcatcaaagaagcacatttaatcaaatatggtagttcaccagcgacaatggttgtttctaaagatgtatatcaaaaaagagcagataaacatcccgaatatcaaggaaagaaagcaggaatcattgttttaactgctgaaggtaagattgattatcgtgttggtacattctatattccatcaagagaagaacttgtgggcggatggtgtgaagtctatagaaaagacagagaacctgaacgtgtagaagtatcccttgatgaatatgttggtaaaaagaaagatggaacagttaacgctcaatggagtggcaagccagcaacaatgattagaaaagttgcagttgctcaatgtttaagagaagcttttacatcagaattccaaggaatgtatgtacctgaagaaatgggtgtcgaagatacgacaagtaattttgttgtagaagaaactcctcaagtgcatcaagcaattgaagcaactactgcaccaacaatgcaagatatcatcaatgaagaaaaacaagccgaaaaagtaccggttgatgactttgatccaatgtcaatgtagaggttttcaaaatggataagttaaaggaatttagaaattccaagaagttatcgcaaaaagacatggcaattcagattggggtttcgccttcgtattactacaaggttgagagtggttatcaaactccaagctatgaattcctattgaagtttaaaaagaaatttccaaatgtaagtgttgataaaatatttttctaggcaaaacaaaacgtcaataagagcgctattcttactgacgtttgcctgaatttgtttactctttacgtatgcaagcgaaaaagtataaagcttaatcactacactatatagcgcataatgcttctatgtacgcatcatcacttatgcagtttcagttctgcatgatagccttcaaaaaaagctagttaaaggttggcccgttagttgatgattcatgggaattgatgtagttctttagcattttagcgtgtgccatcactgcgttattaacgtgattcccttcacgaaagtgaaaactacagagcaattatttttacgcctgttgacctgtcgaggcatcagtttgttgtccccacaataagagaacagggcaaaatcaaaagttttgtcaaaaagaccactctccattctgccacataggcaagatatattttatcacaatttggaaatttataaaagaaaggatgttaacaatgaaatgactagagaggtagatacgaaaggctatgtaaaactgtatagaaaagcaatgaaggatcctatttttaaagattctaaagcatggcatttattcacgtattgcctctttaatgccacctttgatagcaagtatggcgaggttgggtccttcgttactacaatggatcaaattaaagatgatttaggatggaaaacaagaatgacagtagataaatttatgaaaatcctaaaagagggttcgtatattaattataagacatccaataaagatactactatttatgtacctaattattctaaatatcaagattagataaacgaatttgttgtctaaaaattatacatccgttgtataaaaaatagacaccggttgtctaaaaattatacatccgttgtataaaaaatagacaccctatctttattatataagaacgtaaagaacgtaaagaacgtaaagaacgagtgagtgagagcatgtgcatagataacattgcttcgaaagcgagttggcagattgttatatatagtagtaactcatctctcagaaaggaatttagaaattttggaaaaaaaggaattaagagagattttgaaattttacaaaaatatttatataggctcaacgttggatataaatgacaaatctctattctcaacatggtatgaatttttaaaagattattcttttgaacaagttagaaatgcaattatcaaaagatcaactcaatcaacatttccagcaaatatacttgaaatcatttctaacatagaagttcctgaatacacaattgaattaattgaaccctacaccgtaattgttagttttgaagatgaagaatatggaaactttccatttagattcttcaattctcaggaagctaagaaaaatatcgaaaaatttaaagaatgcagttacgataaggagtcaatcaggatattgcatgagcaacatgtcagagaacgtaatagcggagttcttacatacaggggagaagcaaaagcaagattggaaatgaaattacaaaaccaaaacaaaggaaacagaagatatgataaacagagtagttttagttggtaggatgacacgtgatcctgaacttagaagaactcaaaacggttcagcagttacaagctttactttagcgattaatcgaccaaagagaaatgatgaagaacaacaagcggattacatttcatgtgttgtttggaataagactgctgaaaatgttgaaaagtactgttccaaaggttcgttagttggagttgaaggaagacttcgttcaagatcatatgacaatgctcaaggccaacgtgtatatgttactgaagttgtatgtgattcagttcagtttttagaaacaaaacctagagacaaatatgaagaacaacaatatcattcacaatcaacatacaatccaaatcagtaccaacaaccaacacaaaatcagcaacaagacagttttatgaatgaaaatccacctttcaacataatggaagatgacattcaattctagtctaaaataaaaaacttaaaattttcgtttctatcgagtgtttgttttaaagatgattaactttaccaattatctaaaaacattcgttaggatgaaaatttgaccgcaaaaacaataaatcaaacaaaaaggagaaatgaaaatgctaataaaaaaagatgaagaaccgtttttctataaatttctttcaatagcaaaagaaatcatcaggaaaaataaaagatacacaccagtattttatggcgacaatgaaaagctatatctagtatgtaacaactatgctgcagcatacgacttccaaagtaatttacttttagatgatgagttaagagaatttggaaaaatcccttatgaattatcggaattaccgaatggggatatgaaattgacaaaatctgaacattttagctgtcaagaatcatatttaattgcaattagaaatttcttcaagcatacagggtatatgtcgaaaaaggttttttctgttgataaaggtgatccttacaagattccaaaaatcgttgaagtgacacaaagatggatttctgaagaagataacaagattttggacaaaataggatttcctgatatctatatgttggatgcaaaacgtgttgatgaatttattacgcttgctagtgattggaacccatattatttagcagcgtgtgatcaaacagaattaaatggtggacaaaccactatcacaatgacagtttacttcaatatcaaagaggatcctaagaaaagcgcttgtgatcaacaagcattggaaattgtacaacaacctacaaactatgatgaattcgaagatatggatgtagaagaacctgcagatgatgaacaagaagaaataattgaggatgattaccaagaagaggaacaattggatgcacttcttgaagacactgttgttccagaggaattagaagatgatttcgacccaatgcttgcttgatttaggtatcaaaaatgattacaagaaattttggtttaccgttccaggagcaatcgttggaaaaggcagaccgagatttactacgcaaggaaaattcgtaagagcgtacacacctaaaaaaacaagggattacgaacaaaaaatagcaatgtgctatcgaaaaactacaagttatcaaagcgataaggcattgagggtgaagatatttgcatacagagaaattcctaagtcgaccactaaaaaattaagaggttggctattagataaaacgtttctatgtaccgttaaaccggatatcgataacatcataaaagtagttttggatgcactcaataatgtggcatattacgacgatattcaagtgtgtgaactggttatcattcgtgaatttgctgaaaatgaatgtttaaaaatatgtctagaagaagttggcgaaagaaggccaaaataggaggatagaattatgggattgtttgatttagttagagaagaacaagaagcaaagaaaaaagctgaggaatcagctaaagaagatgtaaaagatacagttgtcaaagaagtgaaaaaggttgaagaagcaccaaaagaagctgatcaacaacctgctccagttgcaaaagctgaaaaacaagcaactgaaattgcagaagaatctaaaaaagaagaaaaacccgcaggtaaaaaagtacctaagaaaaaagcaagtactgaaaaaacttacaagtatctatttggagtctactctgaaggaagattgattgatatttcttcttatgggtttgtagatggccaagattatacagaaaaggaaatcacggacatcatgttacaacaccgtcattatgagtttgcaggaacaatggaatacagttatatcgaggatgacaacgttcttgttgtaactggaaaacaacatagaaaaggctaggtggttggcatggccaataattatacaagatataaattctatgtaattggagttggtgggactggttctcttttagcaagagacctcccaaaacttcttttaggaacgtcacataaaatgatgctactagatggtgatacagtcgaatctaaaaacattgaacgtcaaggataccaagctcaagacgtcggtgataataaggctttggcattatcgagaaaaatcaattctctttatccaatagagtgtgagttcgatgataaatattgcacttatgaaagtttatttgctcttatccaagatgataagggatatgttcctgtaattataggatgtgtcgataatgatgctacaagaatgattttagaaaaggtatttaaaaagcttgatgatgttatttatatcgactcagcaaatagtgaatatgaaggaaatatctatatcacaacaaaaaagaatggtattcaacaaagtaatttgagaagtcaatgttacaaatttgatttagataagcacccacttgacgtttcttgtcaagaacaggccgccaaaggaaatgttcagtttctagtgaccaatgcaaaaatggccgtatcgatattggaacattgcaacgctttaatcatgtatcagttgaaagaaggtgttcaacttgtcaacagatttgagacagttttttacgactgattatgttccagataaattagaacctaacacttatgaaaagtttttcatcaacgctttaagctatacatcaccaaaagctatagatgatttaacgattgcatttgaagaagatgaatctaatgatctgatacaaaactttcaagaaattgacttattagacgagcatgtttttccagatgttatcgactatgaatttgaagaagttatattaagtcctttttttgacagaaacgaatttgcagttgatggttttgaaacattgattgaaggattatatgatgaacagaatgaagtgtttgtaaatgtaagttttattattccacaattaaaaggtgtcgttagagaaatatatgcagaagccaaagagtggtgtgagtactcggatgaaacattatccgaacctaaggttgattattacaatctaggtaccactgaaatacagttcctgtatatcaaattcaaaaataagggaaaagctaggaaattcagaaagctttataaaaagagctatcaaataagagcaatgctatatggttttggatatcgatttataaatggtcaatttgttaaaggaaacgtaagaaacattgaaattgaaggatgggaatatcctgatttgaattttggagtggcaaatgaagctctagaaatcatggcaaatgtttcaaaaaaagaaaggcacaatacggaattgttgcaaataatagtcgaaagaaaagtagatgattgtgattataaatttacttcaaatgctttgatttcagctctttcaaacacattaaagacaaaaagcgaggtgatcatgtaatgagagaagcaatcattcgtttaaacaataaaaaagatgatgctgaattatgtatcaaacaaaacgagaagattacattcaaaatgctttcaaaagaagaattggtaaaactttttaatgatttttttatcaaagatcagcatgagaaagcaaacataaaattgttttctgaaaacacaataggtgccggtattgattataccgttataaagcaaaatgagaatatgcgatatgttacttataataatcattcatacaaaatcaattttcctaatgctatttatattgttaaatatgacaacaaaatcgtaaaaggcatccaatgttattgctataagaaatacaaaggtcctgaaactgagttatatgaatatgcaatgccaaatatgttgacaggaaatgcaatgtgcatgggtagtgccgataaaaggattgttgatggtgatattgaagctgctttgaataaaattatcgctacaccttactcacatggaaattttgatggaataaagggattttcaacaacagtcagctattttgaatatttagaagaaaatccatttccttacaaacttttaagaaaattgaacaggaaattaagagatgtcaaagtgtgatgaattaagaaaattacttcttgaatggggtgaaggtaattatttgcccctcaagaaaaaaattgcgtatctggaaaatgaaaattatcgtttgagaatgcaaaatttaagaatcaaagaaagaaatgaaagactttctatgatcaccaagaaaagaagagaggaagcgaatcatgaaaatagatagaggaattgttcgatgtgatagatgtaaaagagttttcaaaaccaaagaggtcaataattataaaatctcatatcaagcaggtggattgaaaagtgatggtggcatgggacttgtaagaaagaaagcagaaatctgttccgattgcaatatggattttgaagacttcatgcgcaataaaccagttgcaggacgtgatatcaatgacaggtaaagaatggtcaaagttatgtaaggaacatggtgttgttgtccttgatgcaaattacaaagatatgacacaagatgatgctttaaagtattttgatttattaaaaactgcaatggatcatgcttttgctagaaaatatgatttggaaaccggccaatatgaagattatgcattgcctgaagggtctacatattacgaagatgatatgaacaagaaagttgcctgttgtgaatgcgaaaagaaaatcatgtacggaacttcttatacatcaagaatcatcttgaatagcagtggatttggctatgcagtatgtgaagattgttattacaaaaatgacatgaaagatatcgttaaggaggaattataaaaatgggaaatgaaaaatcaaattatgaaacatataaggaattaatggaaaaatacaaatttaagattggaagacctagtgaaatcaacatggatgactacgatgttgttgtgtcatgcaataacgttggatacgctcatgtaaaatatacagttcttaaaaacgcccctaatttaactgatagagaaattgctcttctttgtgatggtggtaatttatgttttggctatcgagtggaaggaaacactatttgtgtttatacagattaaagcgttaagaaaggttaaggtgtaaaaaaatctgtagattgcagaaaaaacggtactaaggaggaacaacaatgaaaacagtagaagaattagaaaaagaaattaataatgttgaagaaacattaaataatttaaaaacaaaagttgaagaattaaaaaagagtaaaaatggttttgaaccaacaccaaaagactggaaacctaaatgtggagaaaagtattggacagcatattataatttaaacccaactttttttatttgtgatgaaagagagataagtaaaaatattattaaatacaatcgcatttttaaaacaaaagaagaatgtcaactatattgtgatgttcaaagagcatttatggacgcttctagggagtatgttttaaataaatacaactacgttcttcgttatgcgcacgaaggtgggaaagtattcataacaccctatactaatgttcaacctacagaattatttttcgacagtgaggaaacagttcaaaatctcattgataaattcggtgaggaaaatatcaaacgttactatttaggggtgtattgatatgaaaaattttgaagcgtatgaagaaaaaatcaaagaattaaattataattttgcgataaaaaacgatgaatgtgtcaggtgtattaatatttgcgaaaggtgcgagttcataagtaacccttttggtagttgtcctcaaaataaaataaaatggctctacaaaaaatacattgaaccaaaaccaaaggttaaagttcctttagcaactaaatactttttagaaagtttaaatgataagtatgaatggattgcaaaagatgaagacggtgctgtttggtgttataaatttaagcctgaaaaatatacacaagataaaaacaaaagatggactgtatatggtaggggtaatattgctggctttagagatgttttcaaaaaagaaatatttgattttctttcatgggaagatgaggaaccaactaatattaaagaacttttagaaaattgtgaggtaatagatgatgaataaaatagaagaatttaatgttgatgaatatatagataaagtaacggaaacaaaaaagatatttagacaatcgcttgaaaaatatggcaaagaaccacaatgtagacaagctatggaagaatgcgctgaacttattcaagcagtgaataagatgctacgctatgaagataggccagccgaacctgagtattatgctaatttaattgaagaaatagctgacgttgaaattatgctatatcaattaaaagtgatgtttaacattgatgatgatcaagtgtttgcttttaaagtacaaaaagctaaaagagaacaagaaaaggttggaaaagttaaatgacagcacaagaaatgtttgaatcaatgggatttaaaaaagaaaaatttgattattttggattagatcgatttatttataaaaaaccaatcgtatatgaagaagaatacttatatacatttgtagttttgtttgataaagagcaaaaaataacaacagtataccatgatgagtattctgaagattatgagtacggttatgatgcaccacctgcaattgatatggaacttttgaaagcaataaatcagcaatgtaaggaattggggtggttagatgaataaatatcaagaagcattaaacagcattgaagaaaaaacaacgaaaattatcgaacactgtttacccgctattaaaattcgctattgcggtgatgaagtagacatattaagagaattagtagaaaaggcaacacctaaaaaaccaattaaaaacgaaatggggaaaatttcctttcttgataagctttttggaactgaagatgcctatacttgtccaaattgcgggaatgcattactaaaacattccatgaatgaacgtcaagaaactagatattgttgggattgcggacaagcacttgattggagagttgaaaatgactaaatcaagaggacaactaatatctaaattacagcacatgaaacaaggcaacaataacaacgcaatcaaacatatcaaatatgaagatatagatgatatttgcaattatcttttagaagataagcaagagattgaaaagttagaaaaagcacttgatgaagcgtgtaagagattatcatacgaaaatgaaataacgtgtatgcacttaaaacaacaatacgcttgggctaaaaataaagtgccaaaaaccaaagaacaaattaaagaggagttgatgaaaaatgactaaatttgaattggatctattaaaagaatttcaagataatggttgtggtggagatgactttgatgaaatcagtacattagtcggcatgaggatgagaggctactttcaagatgccgaagatgatgaaaccattgatgaattgatttggaggtatgaagaatgtataagtcaccaatagaaatagtaatggaagaagtatttcaaaagatggatgaggattttgaaaatgcagtatttaaagctgtacgaaaagtcggcataaatgttgataaagaagaactcctaaaagctctaatttatgatagaggacaatatgataaaggatatgaggatgcgatgaatgaggtcaagcatcctcaaccactcaaatttgaagatttaaaagaaggaatgtggatatatgatgctccttatgaagaaattgtaagaattaaagaaatagaatctaatgaatggatatttcttgaatgcataaaatccaaggatttatctaatacattttttcaagaaggaagattttatccaattactattccaaatataggagataaaaatgggtaatcagtatagaagaatgcaaacagtaaaacatgctttgcaatactatatcactagaccaggagcaagtgaaaaggatctagtaagagaaaagaatttattaaaacgtgttgaagaagatattgaatggtatgaagaaagacaccacatcaaaaagaaagaggagagaaaataaatgaaaaaagtattaatcatattagcaagcgtatttgctttaactggatgttcaaaagcatctagagttaattggaatattagagaagatgcaaacaactttaaaatcacaagaaaagtcgttgctcttaatactagaacaaatgatccattattcactgttgagggaaagatttcccttgatagtgatgaagatggagatttaaacgtaacaatcaaaactggaaaaggaaagtacaagctgttctatgcacatttgtcaaatgatgttacatacacttgtattcaaacaaacgctaagaaagaaaatccttatgcctatgacattcaattctttccggcaaaagaagttattgaaaatggtgttattgatatcaaatcaagtgagtaggtggtaaataatgcagaagattaaattagaagctgaaaatgatttagaaaaacgttgcaaaaatttaaaagaacaaaatgaagcattgattagtggattggatcttgcaaatgaaacaataagtaatctatacggtttgcttcgagaataccgtcaacaaaaagaaaagcttttaaaacaaaatacaaaactgttagcgatttatactgtaatcatcatagctcatataatcactgcaatcattaatcaatcatatcgaaattcactcatgttttattttctctcggtcgtaagtattgtgtatggtattgatttatgtagtcaaaaattcaaaaaaaggtgattgaaatgaatatattaattaaaaagcttaatgattgtcagttgactaatcaagaaatcaaatacgttattggtcgtttaacgtgtgcaactaattttgataaggaattgcatctgaaagcaattaaaaagctcgaaatacaaagaaagtaccttgaagaaggcaatgtagaaataaaagaagatggtgataaataatgtacattaacccattttggtgtggagttgcagcaactatccttgctgaattggcaggaataattgcttatgcaatttatcaagatcataaaaattaataattaattattttggagggcaaggaatgaaatatacagatgaagaaaagaagatcattgatgaagttaaaaaatatcttagagaattacgcctaataaatattgaaaaattctctttaacatttgaaattgaggacattccaagccctcaatcaattaaatacagtgatgaagctcctggaggcttttcaaaatcaaaaggagaacaaattacttctaatatgctacgcagagaacttttaacaaagcgtctagagctctttaatatggaacttgataaatttatgccgttagtatatttgctcaatgcaggacatagaaacatcattagaacgtatgtatgttcaagagggtacaatgaaatgattgatacattagaagagtcgttttgtatcagcaaatcaacttacaaaagagagtttccaaaagcgtgtttagaattatccaaatatcttgacatggaacaccgcccatcacttgaaaaattgaataatatgttttatgaaagtatcaagaatgaatagaaatttcattctttttattttctataaatctctatatatgtcgctataactctctatatgactatataactcgctaaatgtcgctttttttcgataaaaaactgtccattttttctttgtttgtgttatattatttatgtagcacggaggtaagattaaaataaaaataatcattgtgtctacaatgcttttcgtaagtatgggattaaaatagcatgctaaaagaaaaaaggaagaacggcaattcttcctctttttctacttcgaatactagctttaagtaagtgtgggattagttcaacaacattttagttgctactaagattaaaaagagcattactaggtattccatgaatacttgctcctttccttacaccaaagctaatattcttgcttgatgtaaatagcatgttgctagtacctccgtagtttttattgcacatctttgtatgtgcttttttattttatcacattttattttaaaatgtctatttgggagtggtgctaaaaagcaaatgaaagcagtgtttcaaatctctagagatagtatttaaaaccttaaataaaattacttttatcacgaatgataactttttattaaaagtggacccaatttggacccaaaatgaacccaaagtgagccctaattggacccaaagtggacctagattgaacccttatttccatgctattatgctattgtggtttttaaagaaatgaaacaatcccatttaatttataaaatcacagttcagacatataggttaaaccccttgaaaaaagttccttatgggagcttttttctttttcaaaaacaaaaaggagacagtcatatgattacaacaaatgatattaattctatattagggattaaagaggcgtttcaattacatggagctttgaaaagtgttcttttcgacaaaagtaaaagagaagagatatttaataaattcttagaaattgaaaatgatttatcatatgattggttcactaactattttcaagaagagcaagcaaatcgaaaaggcatgatgcaagattacacacctgattgtatttgtaaattattgtgcgaattaaataaaacaaataattcgaatcaagaaatcgtttttgattgttgttgtggaattggtggtttaacaatttctatgtggcaatcaaataagaatagaacattttatttagaggagctatcagataactcaatgatgatgctcctttttaatttatcaataagaggaatgaacgcttatgtccgtcacggtgatgttctgacaaatacgttcaaagcatattataaaattcaaaatgatggtaaatttagcaacgttgaaattattgatagtatggatgatgatttcaaagtcaatacagtaatcagtaatccaccatattctttgaaatttgatgatgtggaaagctttaaagatgataagagattcattgattttggtattcctccaaaagctaaagcggattatgcttttattttgcacgcattatcacatttgaaagaaaatggatcaatgtattttattctacctcacggtgttttgtttagaggtggaaaagaagaacaaataagaagaaagctaatagaaagcaatcttttagatgcagttattggtcttcctgaaaaactttttcttaatacaactattccggtttgtattttagtcttaaagaaaaacagaaataaaaaaggcgttgtgtttgtagatgcatcaaaagattttattaataaaggtaagcaaaatgagttatcaaaggaacatattgataagattgtttcctcatataatagtaataacgattttttgaaatatagtcatattacaaattatgatgagataaaaaaacaatgattttaatttgaatattccaagatacgttgatacttttgaagaacacgaacctattgatttaagagcaacaatagaagaaatcacgaagttagagaatgaaatacatgatgtggatatggaactcgctaaaatgtttgatgaacttcaaggacctctagaatatcagaaaagcaaattgaaattgattgagcacttaaataatcgttatacacatgacatttcgaatgcgttaaaaagaatttatgagtttattaataaagaaggcaaattgaaagaacataagaaaatgaatctattagatttggtagatattgaaaggtctaagaaaaacaaattatatccagcggacagtatcttgattcaattgtctgctacacgtggccaaatgcaatatatgaataaatcaggtcctgcagatgctaaatatggagtaatgatgttaaagaataaagatatcaaccctagatatctttatttcattttaaatatgaatatggggcctttcttgagtgtttatcaaacaggattgaatattgttcctgaagtatttaaattcatgaatttagaaatacatactgatagacaaattcaagataagattgcagacatgttcgatgatcttgaaaacatcgaagttaattatcaaaaagagattgctaaatggaaagatattaaacaatttcatttagataacatgtttatttaaaaaacaatggaggtggtgacatgatttggaaaaacacgagttagcatttgaagactataaaaatggcatgaaacaaaaagaaatcgctaaaaaatatggtacgacaatcaacactgtcaagtcatggtcacgccgttatgaatggtccaaaaagaagaaaaagggtgcacaccaaaataaaagtgtgcacaccaaaaaagaatgcaaaaaaatagctgaagaaatagtagaaacaagtgagctggatgaagaacatcagctcttttgcatttattatttaaaatatcataacaaggtcaaagcttatttaaaaataaaacccaaagctaaatataacagtgcttgtgtcatggcatcaagatggtttaaaaaacctgaaatccaagaagaaattaaaagactaaagcaagagttatatactgatattcttttggatcctaacgatattgttcaaagatacattgatattgcttttttagattccgatgaattggatgggaaggcaattaaaatgtcagattctcttagagctctcgaatggttatcaagtcatttgaacatggccaacgaagagcaaaaactcaagattgaactattgaaaaagcaattgaatacgaatgatcaagaagatgatggagttgaaattataaatgatgcaccaatttaagaaaactaagaaaaaacaggttcgtatttcagatattgtcattccaaagtttttgacctgtttcaatgacatttcacatgttcataagattatggacagcggacgtgctggtaccaaatcaagttacgctgctattcatggtatttacaagattgtaagtgaagatgaatgttcagtaatcgtcatgagaaagtttcacaataagctttctaagactgtctacaatgaattcaaacgagcaatcaaacgtctaggattgaagaaaaaacagtttaagataactaagaatccaatgaaaattacatatcttaaaaatggcaattcggtttattttacagggaacgactctattgatgatacaaaagggatcattgatgaagaaaaacctatcaaacttgttattttggatgagctgaccgagtttttcgaacgtggccaaggagaagacgaaatatccaatattgaagcaacattcgttcgtgggaatgatgatgaattctgcatggagtattatttcaaccctcccaaaaatcctaatgcttctatttttaaatgggtcaaaaagatggaaaaacgtagtgactgcattcatatccatgttgattatagagatgttccagaaaagtggcttggtaaaaagcttattcaatcagcaatggaaatgaaaaaagtcgatgaaagaatgtacaactggatttggcttggaatttcaatcggtttagatgaaatcatctattacatgttcaatgaaaatcagcatgttcttaatagagaacttacgaatgatgaaataaatggaattaacagaatagacgcatcttgcgactacggtcaaatgaatgcaactgtatttgaattttggggacttaatttggtacagcaaaaagcttttggacttgatgaattctatcattcaggacgtgaatctggtaaacagctaactcctagtgaatatgctttcaagtttaaaaaagcgtgtgaaaaaatcaaagaagcttacggaatgtatcctcaaaatttatatattgatccaagtgcaagaggacttgctgaagaaataaaaagagcatgcccttttataaaaataagaggtgctcaaaatgatgttaagttgggcatttcaagggttcaaaagtcaattagctttaaaaagatacttttcagtagcaaacaaagaatgctcctaaaagaaatcgtaatatacagctatgacaaaaagagcatagaaaatggtgttgaaaagcctgttaaggaagatgatcactgtatggatgctatgagatattacattatgggcatttggaagtatctcagaagatttcttcctgatgtcgagaagaatgaaggtggtgaggatgattagtgtttacagcaataaagaaatttctagaaaggattaagaacagaatgtttgcaacaaaagatataaataaatttttcgatatcgatattgcaatgtcgaatgacatggtcaattcaattgatttatggaataagattttagaaaacaagcagccttggctaagtaaagaaaaaggtgtcaaatcattagcattggcacaagggatcagtgaggaactttctaaaacttcaacaagagaattgatatcaaaagtcatatcaaatgattttgtcaatcaggaatatcaagaattcatcaaagatatgaatgaaaatcttcaatgggctttaggcgaaggcggtgttgtttttaagccatatgtaagtgacaatcaaatattcgttgatgttgtacatgctgataagttctttcctgttacgtttaatggaagaaagaaaatcaccgcaggtatctttgtagaacagatttttaaaggcaaaaacgtgtatactcgattagaatatcaaaaatatgaaaatggagtaaatacgtttgaaaactatgcatttatgaaaaaagattattctcaaggaaattacaatttctatacggattttggcaatcaaattccattggatactgttcctgagtggaaagatttggaagaacattttgagattggtggcgttgacaggccacttttttcttaccttaaaacacctgtcatcaatacaattgataaaatgtcccctcttggtgtaccatgctatgtcaaggcaatcaatctgattaaagatgcagaggaacaatacagcagatatatttgggagtttattgctggtgaaatggctgttgaggcttctggtgatgcatttgaaattgattcacacacccatgagccaaaacttcctgaaggaaagaaaagattgttcagaacatacgatatcgataattcatcaggacaagcaacaaacatcaatgatttaatcaaagtacatgctcctcaattaagagatgccaattatgctgcaggatttaatgatattctaaagagaattgaatttgaatgtggtttatcatatggagatttaagtgatccacaacaagtcgataaaactgcggaagaaatcaagtcatccaaacaaagaaaatatgatactgtttcagcaattcaagacaatttgaatactgtacttgaagatgtagcgtatgcaatgaatgtttatgctattggaatgggtaaatctaattccatggaatgtgttgttgagaccgattggggagacagtattttgactgatactgaaaaacaaagaaatattgatcttcaagaagtcaatgctggtttgatgcctgaatggaagtacaaagtcaaatggcaaggtatgagtgaagaagaagcaaaaagagaagttgctgaatcgtctgaaggcattggatatgatgatatcgatgaagatgataatgaagatagtgtaaatgttaactgataaatttttagaagagtcgggtgatgatgtctcaaatgacttcagcacattggaaactcttcttttaatttggatgggtttacgtttaagaaaccttgcatctttagaagatatcgaagaagagtatccaaaatggaaaaataaagcttgtagagagttttttgaatattcgggtactgaatttcaaaaggtcaagaaatcgtctcaaagcaaagtgaaaacagctatcaagaatggaatagcaatgacagtaagcaatatcttttcaagattaaaagatactgattctcaaacttctaaaaaagagatgatgaacaggtcaaacaagaatttgaacaaaggtatcaaggatactcaaggtgaaatcaaaaacctttgcaacatttcaagaaagtgcaccaacaggcagtttataaaggcatgtgatgaagcatattctagaatcgttgcaggaaacaatgctgacaaggccattgaatcatcaatcagaaagctttctcaaaaaggtatcgaagtagttggttatactgatcatacaacttcaatggatgctgcagttaaaagagcagttacaagtggtgtcaatcaaacgtctttgaagtttaaaatggataactgcaaagaattgggcatcaacattgtaaagacttcaagtcatggaggtgctcgaccatcccatcaggagtggcaaggtaaattattttatcttcatactcctgtaaaaggtctacaaaattttaaaaaagcaacgggatacggccgtgttgatggcctaggtggagcaaactgtaggcattctttttatgaggttactgattatgagtataagaacaatctagtcgataccgaagaatttgacaagaacaggaatgatgatcaatacgagctggaacaaaagcaaagatattatgagcgtcagattcgttcttggaagaaaaggaagaatattcttgatgaatgcggtgtagattccaccaaagaagctaaaaagattagagaatggcaagataagcgttctcaattcattaaagaaagcaacattcaattcaagaaagaacatggtattgataatgttcttaaaaaggcttatccaagagagaaagctatcaataaaaataccagtcaaatgtatcgacctattattcatagcaaagatgaaactcaattccgctattcaagagatatagatttgaaggcaaaaagagtaacaagctatggtgacgaggtttatatttcaaacagggcaactgttaaaccaagagcattacataagatagtcaacaacaataataaagctagagaattatatggaattacaaggaaaccaaaaattattatatttgacccgttggaatatgatagagcctacggtaaatacgatgcagttcacaatgtagtttattatagttcacatgcatataaaaaatctgtcattgaagaaactgaagttttcttacatgaaatgtgtcatatgaaacaggcacaaaattatatagaaaagtttggtgaaattactgctgaaaactatactgactatattgattttgtgtgtgcacaggcaaagaaattcattgataaaaaaggtataaaagaatataatgtaattgagattagtgaatatgcaagagctaactatttatctggtcgatttgacgaagtagaagcagagtacatggcacttgtaaaaaacaagaaagggatgaaatagaatgtcagcgtatataaagtacccagaagaaattcaaaaatgcatagatatttatgatccttatggttctcaaattgccaatggtgagctagataagcttccacaagaagtgattgatgcatataacaaagcaaaaaaatggttttgggaacaaaaacagtaaataataagtcaacgaaagttggctttttcttttgctcaaaatcaggagatatgatatgaaaactgtaatcaaagtattattcgtttttttaatcgctttaaagcttattgatctattcatttgtgggttatggaaaattcttatcccactttttattttcggtttaattatgataattgcttttattttagaaattttttagtaaaaaaggagaaaaaaatgagttcaggtgaatttattgaaatttgtaaagaagaagttagaaagcacaatgagcaacacatggataaaaaagaagattttgtagtttttgttgtatggcaatgtaagacattacaaaaccataaggctattttaagtgcatcaaataaaggagctatgttgtatgaatgtacgtacaatggagacaagaaagagctctatattaatgcttataagaaaattgaaaataaatgtattaaatgttagaaggagaataattatggaatttaaaaaagcatttgatttaatgaaacaaggaatgaaaatgaaattaccttcatggggtggttattggtattgggacaacgaaaaagaaacaatcattatgcataccaaagaaggaaaagaaatggatattagagaaaccgaaagagttatttatacgttatctaatattcttgatgatggatggattcttgctgatgaagaaaactgcccagaattaggtggagaagctacttttggttttgatgaagctatcaaatatctaaagcgtggaatgaaacttgctagaaaaggttggaacggtaaaggaatctttattcatttatgtgaaacagatgcaacaacaaatccttttgtttgtatagattcatctaatttacaaactgataatctagatgcaaagaaaaatattgtaccttgggcaccatcacaaacagatatgttagcggatgactgggtattttttgaataggagggtgcataaatgaaattattcattagccaaccaatggcaggaaaaacagataaagaaatcctagatgaaagagaaaggattttacacaatgtaaaagaattatttcctgataaagaaattgaagtgattgattcgttctttgatggtgaaccaaaaacgcctctttggtatataggagaatccatcaagctattaggacaagctgattttgtttatttttgtaatgattgggagaaatacagaggatgctgtatcgaacatgaatgttgtgttagatactcaattaaacatgtagaggagcagggggaagaatagaatgaatacggtatatgtatttaagagcggtgtacatattaattcttcgacaattaaaaaaattacaaaagcttattttgaaatagtaaaaaaagagcttccagaagaagcacttaattttgaagtcaatgattttattcttgaagaaatcaaagcacaaattaaaagcaaaaagatttgcttataagtgcttggaataaagaaatcttgactccttaattttgaggagtccaatatttgttgataattacgaatctttttcaataagtttttatgtttgatttcaattatggttagcgctattgaaataatataaaaagatatgaaatgatataaaaaataaaaaagctcctactcatttgagaggaagctaaagtgcatatcatctattacaaaattatcatattttaaagtatcagtagtatatttatcaattaatgatttaacaacaatttcgtaagtatctgcatcaattgttttatcgtcataaatagcttttacttttgaccattttgttaaaaattcatttaatataggatttttgactattaaagacatatcgtattcatcttgagagtaatgatactcttctatgtcaatatgaatagatttacagatatttactattaaattgaaaatatcagaatatgatgagaaattttttgttttatgaatatcagaaagcccgcaaagccaatctatagaaatattgcattttattgcgatattgtacaaagtatcaatattgggtgtttttgatccattttcatatgaagaaagtgtagtttgagctacgtttattaaatctccaaattggctttgtgttaaattcatagactctctaagttcttttaatctttttgctagtatttgttcgttcatatttaccacctttttattatattataaatagtttttaataaaaataaatacaagttaataaaaagtattaaatattattgactaattatatttataattgtaagataataaatgtaaatgaaaggagggatagatatgaaaaacttaatacttaaaatcgatgaagagttacataagcaaataaaaattcgtgcaaccgaaaatggtcaaaccataaaaggttatataaccacattgataaaaagagatttaggtataaaaaaagacattcgcaaatagttttgaccgactaacgaatgtcacctaatcaaggcactaatagtataacatttagtgcctctaatttcaaatgaacagaggtattgtgctatgaatttttaaatatctcttgacttttgtgccccacaaacatattatgattattgtagggtacaaagaaaggagggcagtatgagtccaaaaacaggacgtcctactactgaacctaaaaataagtttttgaaaatgagaatgtctcaagaggatttagacaaattaagttatgttgccgaaaaaacaggcatgacaaaaactgatgttgttagaaaagggatagaaattcagttagcaggattgaaagacaaataaaaaaggtattcgttagtccgtcaaaactaaacacgaataccacctacaaaagaggcatttagattatagcactaaatacctctaaactcaaatttcaaaagaaagaggtaaaagttatgttagaagaattagacagtttgttagacgctctcatgaatattgatgataagctaaatgaattacaaagaattaattcaatggttatcgttacatgtgatgcatgtgaaaacgggaatgatattaaatatgatgttgcaaatgtcatggtatttattcaagaacaaattgattccttagatgatgatattagatcaaatgtttcaaagtgcaatgctttaacaagaaacattcaagaaacaattaaaaaaggaggttgtcaatatggaagaactacaaatatttaacaatgaagagtttggaaatattagaagcttggtgattggcaatgaaccttggcttgttggtaaagatgttgcaagagcattagggtatggtgaaggaaagtcattaaataacgcagttgctaagcatgtcgatgatgaagataagggggtcactgaaatgatgacccctggtggaaagcaaaatgtgaccatcattaatgaatcaggcttatatgctttagtctttggtagcaagttaccatcagcaaagaaattcaaacattgggtaacaagtgaagtacttccaacgttgagaaagactggttcatatgctaaagtaccaactgacccaagagaattgcttatgttgacaattaaagcccatgaacaaacagctcaaagagttgatgttcttgaagaaaaggtatctgatttagaaaaatcaacaacgattgacagttcacaacaatatacgcttgaaagaattgctaaaacaactgtaattagtgcactaggcggtattgattcaagagcttaccaattaatgagcagaaagcttttcagcaacatttggagagactataaaaagtatttcaaattaggctcatatcgagataccctaaagactgattatgaaaatgctaaaaattatttagaatcatggtctcccgaagtcaatataagtttgaaaatcaaagaatacaatagtcaattatcaatggtattagattaaaaattaaatatgaatatgaagcgagttcaaaagactcgctttttctatacgcaattttagagaaaggaggtgtttttcaatggctgaaggattaagaccacatcatcatcaagaatttgaatatcatactattcaatattttgataagaaaagacacgttattgttaagaagatacagtatatgtgtatgatttgcggtcgtgttcgtcatgaaaaatacgattgctacgtaccgccacctaaaagcaaaacaaaagcactagagagaaataaaaggaaatacggcaatagagactgatatttcctttttttgtacccaaaaactgaaaacaacatagcaacacatgaataaaacaaaaattttgaggtgggcaactcgtaaaactgcaaccgcacaggctgatgcaaccagcgtactaaagcgtagtgaatgaaaggatcttatgaaaagagaatttttaaagaatttaggattaacagatgaacaagttaatcaaatcatgactgaaaacggtaatgacattgaaaaataccgcaaggaagtcgaatcaaaaacaaaagagctagaaacattgaacacaaaatatgaatcagctcaaaactccttgaatgatgcgaataagcaaatcaaatcatacaaggatatggatattgaaggtatcaaaaattccgctactgaatgggaaaagaaatataaagatgaaactgcagaattgaacaacaaattgactcaacaagaaagagactttgctactaactcatactttgcaggaatgaactttacttctgaaagtgccaaacgtggaatcatttctcaattcaaggaacaaaactttgaattgaaagacggcaaattcattggagcggatgaatatatcaatggtttaaaagaatcggatgcaggagcattcgttgttgaaaaaactaaagatgaaccttcattaccaacatttacaaaaggtactgcttctaaaggagcaccaggtggagaaaacaatgcaaatgcattcggtttccattttgcaggtgttagagcaatgccaaaagaataacagatcaggaggaaattaaatatggcagcagtaaactatgcacatgcatatcaacaagcgttagaacaagcttggccttatgcgctttatttcggagatttattcaatactccaaataaccaaaaatatagatgggtcaatgcaagaacaattgaaatcccaacattagaaactacaggacgtgtagattcaacaagagatacaattgccaatgcaactagaaactacaataacgcatggacaccattaactttaactaatgaaagaaaatggtctactttggtacacccaaaagatattgatcaaacaaatatggttgcttcaatcggtaatattactgaaacattcaaccaagaacaaaaattccctgaaatggacgtatattgtgtttctaaaatctatgctgaatatcaagaattaggtcaaacacctattactgatgaaatcacagcagcaaatatcttagaatattttgataaaatgatgatcaacatggctgaagcacgtgttccatctacaggaagaatcttatatatcacaccagtttacaatgcaatgttaaaacaagctgaaaaattagctagaactgtaatcattggtgatgctgaaaataaattaaacagaactatcgctaacttagacttggttaaaatcgttgaagttccatcagaattaatgaaaactgtatatgacttcacacaagggtataaacctgcagtttctgcaaaacaaatcaaaatgttcatggtgcatccattagcagtcattacaccaatcaactatgaatttgctaaattggatgaaccatctgcaatgtctgaaggaaaatgggtctactatgaagaatcacatgaagatgtatttgttttaaagaaaaaagtaaattcaattcaatttgcagttgaaaaataataaagaggaggatgatctatgtcacaagtaagaaaaggaaatagaatccttacaatcgagccacatagagttgatgactatgttgctcgtggttatgatcatattgatgaagaatctggtgaagtcattaaaaaaggtgacccagtttctttagcagattttaaaagagaatattcatctttaaaagcacaaattaaagaaaaagatgcaagaatcgttgaattagaagcacaaaacgctgatttaacaacaaaagttgaagaattagaagcaggtgctaaaactccagcaaaagcatctaaagctaagaaagatacagcagaagaatagtatgaaggtttcttatgaatattacgcagatacattcaaaggaaaaatatgtcagcctgaatttgagaaccttgttgaacctgtaattgatttagtcaagggttacgctgaacaattcattgcaccatgggcattagagaaagatatcgattattactgtttggaattgaaaagagcagtatgctatcagattgattatcttcaagcaaatggtggtttgaatgccttaaatggtacaagcgatttagatttacaaagtgtatcgaaagacggtttcaattatagttatggtaataggggcaacaaattcaatggtgttcctttttcatccgtttcagcttatatgattaaaagtgaattgagaagaaaaggtcttatgtgcagggtggccaaacgatatgattagctctcctcgtattttaagaccttttactgttactttgattcataaagttgacgaagatacttttattccatacgttcttgaaaacgttggatttgatgaaaactatggcattacacaatcaaacaaggggatttctgatgcggacagtgttcttttaacgattgatttgagtgactgcggtgatttgacatttgttgatcaacacagttacaagtcaaaaaagaatacttttatgattggaaatgaggattattttgtcctggatgttgtaaaagaaacggactatgatgaactgaaaaagacaaccaatgtctattcaatcaataaatatgcctgttatcgcccaccaggaacgaaagagatccagtttattgaggtgtatgcatcttgaagatttctgttgatgttgattttggaagtgtaaaaaagggcattgaaagtacaaaagaaaaagcatatatgactttgaaaaatgatgtgataagagacacggacccatatgtcccattttcaaatatgcatcatactcatttaagagaaactcctgacatgaataaggagccaaaacaagtcatatatgatactgaatatgctcaacgagtgtacaaaggtactagcatgaattttgataaatctaggcatccaaaagcaactgccaaatggtttgaaaaatcaaagaaagcaaacatcaagaaatggattaaaagtgtagaggacgtgtttagaaatggaaaataaatcaaataaaaaactgacatatgaagaatacaacagggtattggattgtatctatgacttttgcaagaagttggatattcaaaatgtacaaaaaaacatgtggaaattagatttctttacttcaaacaaggatgaccaaatcatggttcaaagaatatctaatcgtgctgaaaaaataaatgaaaacatcataggaggctatactgcggtattgcctttttatattaattttcaatcaggagctaaaactgaaaagagtgtcaaaaaaattacggatgttctggatgcattagcaaaccaatttgaaatggaaacaatgaataaatttgaaaacattgtttttcctgaagatatagttccacagaaattagaaatgattgccaatcctggtgttgaaacctatgacaatggcattgctaatttttcagcactgtatcaattaacttactacaagaaaggagcgtttgaataatggtacaaacattaagaaatactgtagtaaatcgccacgaaaacctacactacgtcaaattcgatggtgtatcaaaacctgtattggctggtactggtttaactgattggactcaagctgtagatccttcaaccgatgacggacaatatatcaatgaaaagacttctcactcaaacatgatggcatacacaccatcggtttcttattcaggagaattgattcctaataatgaatttgtaagacatatttacgaggttggtaagaaagaagtcattggttccatgtttgatgaatatgaaattgaaacatgggcacctgttgaaggttcaagtggaagctttgcagcacatcatagacaatatgaaattcaaccatctaaccctggttctggtgagggtggaggaaaaattgcattggaaggaacttttgctcaaaaaggtgcttccgaacacggccaatacaatgtggccactggtgaatttactgcaggtgaatatgactacacaactggtaaatttacagctgcttcacctcaatcaggtgcgtcatctacaccagcaggcaaatagaaatcaaataggaaagggattattactatgttagaaatcaagattcaagagaatttattcgatgtaaaaattaaagatcgtattttcagtatcgatgctgacaatatcgataatcatttgctgattgacaagttcatcaaaaaatacagaggcaatcgtacaattgacgatacctttattgaagactgtcaattcgtcattgatgaattattaggaaaaggctcatatgattatctttttgataaggatgatttaaaaccttactacgtaatcctagctcttgcagaagaaattcaagccaagtttgatgaacacgctacgactgaacgtcaaaaagaaaagcaagacagaatcaaaaatgagcttgacagtttaaactcacttacaagggaatttggaaaccttcaaaagcaaatggattacacaaaaaacaaatacgggttaaaagattatgttaattctagacaaaagagatcttcaaaaaacaataagaatagaaaatcaagaaatagaaataagaactgattttagaacatggattcaattctcttgtatcgtttctgacaagtatattgatgaaaattataaaatccctatgctgtttgatttggtgattccaaactatgaattgtacatggaaaatgttgattcattggaattactgaaaggaattcttgatttctacaaatgtaataaaccggataaacctgagaagaaacctaataaaaaagttgggtttctttttgattatgatatggacctcatctttgctgcgtttatgcagcagtatggcataaatctattgagaaccaatatgcattggtgggaattcaaagcattacttaatggattgaatgacgacaccaagttcgttcagattgttggatatagaactgcggatctatcgaaaatcaaggacaagaaggaacgtgcaaaaatgaaagaacttcaagattactatgctattcaagaacagggagacccattccaaagaactcaggaagaaatcgaagcagaattatttgaatcgttaggaattccaaaagaataaattaaaggcaggtggtatgatggcagatggcaaagttgtaattgatttagaaatcaatgataaaaacgttgataagaaactcaatacagctgataaaaaagtagataaatttgctaaagatgtatcacaaaaagaagctaaacctaacgttgatgctgatactaagaaactagaaaagaagcttgatgaagcatcaaacgaggttgaaagtttttcaaaagaagctactgacaacgcaaaagttgaaggtagtgcaaaaatggacacttccaattttgaaaagagtgcccagacagtaaaatcagaagcatctgcagttgaaaaagctatagatgttgatggtaaagttgatgttgaagataaagcaacatctaaaatagacaatgtaaagaaaaagatagatgatttcttaaacaaaaaaaacaagccaaaacctattgagcctcctgactctgatgattttgagaaaaagcttcaagaaatggaagataaaatcaaatcattcggtgcaaagattgcaggatatctagcaataggagaagcaattaaacaaggaactgaaattggaaaagaagtctatgaagattttgaagattcagttgcacgtgtcaaaggcgctctaggagaaacagatgaccaagcgagacagactgcacaggtcatcaaggatgtttatgaggctggacttggtgaaagtatggatagagttgccgaagccgttgtaagaatcaagcgaaatcttggtgaaatggatgacggaactctaaacgctattacacaacaagcaatcatccttgaggatacatttgatgtagatatgaatgaaacccttcgaggtgttaaaggcttgatgaaaaactttggtttaactgcacaagaagcaatggactatattgtcgcaggaactcaagaagggttggactggactgatgaactaggagataacatttcagaatattctggaaaattctctcaggcaggatattcagcgagtgaatattttcaattgctaaagaacggttcagaaagtggtgcatataacctagataaggtaaatgatgccatcaatgaagtaactactcgtttagctgatggaactattgagggtgctctaggttcattttcaagcgaaacacaaaagacattcaaagcatggcaggatggaaaagccactcaaaaggatgttatcgacagtatcgtaagtgacattactaaatgtgatgatcaacaaaaagcattgacaatgtcagctactgctttcggtacaatgggagaagatgccaatcttacatttgctaaagcgttgaatagtgttggaactacttttgatgatgtttcaggaaaaggacaacagtttgctgatgaaacaacgactccaatgcaagaattggaatcaaaagttagaaaggtcaaagatcagttacagcctttaggtgatttgttctatgatgtagcaggagttgcacttgataactttacaccattatcagctgttattcttactgtagcaacagcacttgctacttacaaaggaatagttcttctcaccgaaggagtaaccaagggattagcattagcgcagaaactattaaatggcgaaatgaggttgaatccaatcggcctaattgtagcagctattgctgccttggtagctggattcctttatttatggaatacaagcgatggtttcaggtcgttctggataaatctatggaattctataacatcaacatgcgggcctgtgatagatacaatcgtctcattctttactgaatcgataccaggtgcaattgacacgcttgtagagactttcagcaatatcggtcaaacgattgttgaatttttttctgggcttggagaatcaattgcatcattttttactgaaacgataccgcaagcatttgacagtttcattgaaatattaacaggatttattagctcagcaatcgaatttttcaatcagttgccatacaacattggctatgcgattggttcgataattggttttatcgttagcttaggaattaaattcgttgaatttttaacggttgatgttccaaatttcgtaacaggttttatttcttggatttctcagttgcctggtcaattttggacatacataactgatatcataggaaaagtagctgagtttgctttgaatttgatttccaaaggatatgaagcagggtcaaactttgtatcaagcatcatcagttttgttacaggattacctgggcaaatttggaacgtattgtcaaatgctattggaaaggttgctgaattcgttgtcaagatgggttcaaaagggattgaagcagccaaatcactatgggatggaattgtcaatactctttcaggattaccaggaaagatggccgatattggtaaatatatcgttgagggcatttggaacggtatcaaaaatgcaaaagactggttgcttggaaaaattggagattttgcaaaaggtgttatagacggcttcaaaggtgcacttggaattaattcgccatcaagagtcatgagagatgccattggtaaattcttaccaccaggtattgctgtggggtttgaagtggccatgccaaaagctcaaaaatccatgaacaaagaacttgaaaaaatgacaagtgacttgaatggtatcatgaacttcaatttggatgatatcgaactgaaaacaaatcttgatattgcaagacaaacagcatttgaaagcaatgtcacaaatgaattaaaaattgattatgataagatgggaaattcaactgctaaagcaattaaaaacagtggaatgtctttcaaagttgacaagcgtgaatttgccagaattatttagaaaggagcatttatgaaagtatattatgtcaattcaaacaatgagcaaatagatttgttaagtgctccttatcatattgaagaaactgacttttttaactttgagtggtcatatgaaactgaaaatagaagggtcacacgcttttatcgtgatgtcgaaacgaaaaaagttagtgtagatatctttagccaaaatcaaaaagacttctacagtgctctaaatagactcgttgagatatttgatgtagataacgtaagcaatgtcaaaggaaaactcttctataatgactactatatagagtgcaatatctttaaaaaccaaaaagacatgaagtcatatattcttccatacgcaaaggtagatttaactctggtaactgattcaactaaatggatcaaggaagatacctaccatttttacagcagtggtgaaggaaaaaaaactggaacaaagaagtattcctataaatatccttatatttatggtgcaagtgaaggacaaatgacagttagaaatactggagtcgttgaaaatgatattttattaagaatatatggtccggcacaagacccggccattaaaataggagacaacctttatcaaatcaatacgacacttgaagcaaatgaaagacttgaaatcgatacaatgaaaaagaaagctgtaaaaatcacagcacacggtgatgaaatcaatgtttttaatgacaggaacaaagacaacagattgtatattcccatcccacctggtacaaatattgtcgtttggaacaattctttttcatttgatatcgttgtctatgatgcaagaagcgagccaaaatgggagagtgatgaatgatgatggagttcatctacacggatcctaacggaatcgaacaaggaccattgttaaactgtagcctagacttggaaattggaacatatgacaaagccaagaacgactttgaaataaccgtttcaacggacagctgggaccgcaaattgacatatgacagcaagttttattgtgtcggtaccgaatttggtgggatagtaaaaagtatcgaaatagatactgaagctgaagaagtaaaaatagggggcatatgcccaagaaaattgctagcaaatgatattattcaacctaaaaaaagaactgatgaatactatgaattcataggtgaagcaaatgaatgcattcgagaatatatcaattcatcaactgattttttcaattatattgaaaataaatctaaatcagtaagtttaaaaaagaaactggctgatttttttgttgtttcacaagaagatagtggaataaccattaattatcaggcacgttattacaacacgttgcaggcatttgaaacaatgctaaatgatgcaaatgccaaacttaaacttatttggaataaagatggacatattgaactttcagttgagcctattatcaattattctgaaaaactccaattcgacaatgattacaatctgcagattatcgctaaaaaagatataaatcaatgtaatcattgcattggattaggcaaaggcgatttgcaagaaaggcaggttgttcatgtctttaaaatcaatgatcaatacttagaactgagtgaaattgatgatgactctatgattccaagtgaactgaatacaatgacatatgactattcaaatgttgaaagcattcaagaattaatagatggaaccaaaacaaaattaaaagaagcacagactgataactctttagaaattacatttgataatttatctcctgaaattggtgatatcgtaggagcaaaagaatacataacaggtatttctatgcaaaagcctattgtacaaaaaatcgttaaatgtacgtttgaaaaagactacacagactgtgacattgattacaaggtaggtgattagatggcaagttcaagtgatgcagttgaggcaattacattgacaggaaaagaagtatctgcaagtatcgatgcatatttgtttgatgctctatattcagttgatggtatttttacaaaaggcaatcaaatggaagcttctattgtcagcaataataaagtaaggattgctgatggattgcttataaaccaaggacattttcttagaatcaaaccaggaatgtattgcgatgtgccaattgaaaatggtactcaaaacatgaaacgttgcgattgtatcgttgctcaatttaaaattgatgaaagcggagaatcacacgatattgttgtcatccaaggtacacctggagaacaagaaacagttccgtcattaacaaaagatgatcttgaaaacggtggtgctttacgtcaaattgaattgttcagagttcatttgaatggaatcaatatttcaggtgtcgacaggattgctaggacagtcaattcatttagtgatgcaatcttttacaagggttaacatatgagaattattgaaatctatctgaatgaaaatcaatcacattcatgtactagaaatatcttctatgctggaagaaagtatgatagcaacaatacagctgtcaaattcaccaacaaaaatctattcattgatggctggaacttctacttgaaagtagatatggacgatgaagtaactgaaataccattacttcaaaatctatttatcattggagaaaatcttactcaaacagcaggggtattaacctgtacattgattggcagaaacagtgatgataattctactaagacatttgaaccgtttagattgaaaatcgaagatgtcgaatatgatcaggatgataaggaacaacaaccaatggatccaaacatgaagttgctgtatgaacaattaattaatttaaaacaagaattacaacaaaaagaacttgcgactcttcctgcaggtggtaataaagatcaagtgttgcaaaaagcaagcgacattgattatgactttgcatggaaagatatgcagggaacagccactgaaatgtctgatgatgaattagacaatatgtgggaagaagtatttgaataaaaaaataaatagaaagagagatatatattatgagttttgtaaatgattcaattttaaaatcagcattaggaaaaattaaagcttggggagaaggaaaatttgtagcaaaagaaactggtaaagttctatctacaaatgactatacaactgccgaaaaaactaaattgagcggtattgctactggtgctcaagcaaacaaaatcgaaagtgtaaaagtaaatggtacagctttaactcctgattcatcgaaagcggtaaatgttgatctaacagcttatgctaaatcagttgatgtaacaaaagaaattgcttcagcagtttcaggggtaactcaaattgattattcagttgtcgaatcattaccttcaactggtaaaaaaggtattatctatttagttgctaatagtgattctggtaataatatctatgatgaatacatctatatcaattctaaatttgaaaaattaggttcaagagaaatggatctaagctcttatgctaaaaagactgatattccaacaaaagtatcatcattgacaaatgattcaggatatcaaactgcaacacaagtaacttcagctatcaatgctaaattagtagtaatgactgatactgaattaaatacaatgtggactgaagtatttggagcataatcaactaggaggtcttatatatgaaagatttctttaagagagttttgttttcaaatgtaagtgagcacgcatcttcaacaactgtttcagctaatagcactaagtttctaacaagtgatattttgaaaacttttatgacaaagttaaaagatacgtttgctttgaagtcacaattaacatcattgcaaaagcgagttggacagcttgaaaagacagtcagtgaattagaaactgatttaaaggatgcagtatattacaaagagtagatttatttctgctcttttttaaaaggagaaaaatatgaaagattttgaaacacgtgagtgcgttgtacacacacacaggaacgcatttttaattgcagataaatatttgttttgaccgcaccatgcaccagcgcgacctaagacatccgccattttgtccataaatttttcctcccttaaatatttttttgacactaatagtataatctattatgcaaataaaagtcaatggttttttaaattaaaagtaccatacttttaattttaaaaaacatatttttttaaaaaatccgcataaaataagggtttttcaacgtttttgaaagcggttatttttttgaatttttttgttaaaaaaagaaaacgctatcatttagacagcgttttttatgttttttggctattgaaccgtcactgtttgaagttcaaaattgttgtaatgatatctcgtaaatgaatattcaaagataatcccactacttaaatatgccgtttgttcaacttcaatatatggttcatattccttcaatcccaaattttcttgttctaacggactcgatagatgagcacgtatagttttatgcgtactttgtatctttaattttaattctttttcaatatactggtatatcgagcctttcaaatgctctaattttaaatttggaataatagaaataggcatgtatgtgatttctaaacaatacggtttatcatcaaatactctttttctaataatatgatagacaaaggatccctcttctatttgtaattttttagatatatgctcatcactcggtataaccgaaaattcaataatttcactttttaattcacctttgccttttaattttcgtgttaaacccaatcccgattgtttaagttgagttgcatcttctgaagaagcatcataatcctttacaaaagttcctgcccctcttcttcttacaatcaatccttcttttactaatatatccaaggcttttttcattgtttctttattacaatgataagcaacacataatacatattcataagggagtttttgtccatatgtatattttttatcaaaaatcttacttctaatatcatctgcgatatcaatatatttgaccatagactatccctcctaccataactaaaaataccatacttttaataaatttgcacggactttttaacaagaagattatttttgtgtaaaagaaaaaacaatcctaagattgtttaaactgtggtaaatagtctttatgcgcttcaataagttcatcaataacaatattagcatcatgatcaatttgacataacagatccatacttaaagctgttacagctaaatctctatttccagtaaccgctgcttcacaaaccattctttcaaaagctttcatcatatgcacataaccactaattggtaattttaattcacctgttgcaattggttaaggtctatatttcttttccaatatttcctttttgattctttctttattgttttgaaaatacgtatcaatttcataaacggtcattttatcaactcccgctacacccttattactcttgaccctcttgactgcttcatttagattttcgtcacctagtatcatttcaattaatctcatgttgttgtttctccattcactcgtaaatatatttgaaatcattccctctaccttcatctccatggaattacgatttccaattatgaaactattctcgatttcgaactgttcaaacattgcttatgatgagtaaacatcatataaacattaggtccttcagtattgtgtgtcctacctattacgatctcagctgacttcttgtgataaacctttttcgaccaacggtaccattactgtttttaaagtttactggaattcgttgttcacaagacctcccggggtaattcactaatcctctttcttttacaacgtcttgatttactgtcttggttttacgtttaccttttggacttcgtcattttgttttttcttccactcttttaacatgtaagcaactgttcgtggtatccatacagttcttactttaccattcatcttaagtgatttcaaaaccaatactgttttacattctctttttaattgtgtatcaaattgtttatatatttcatccttagttaaaacacctatcatttccttatcaattctaacaaattgtttatctataattaatctggtattatctttttcaaaatcttcatcttctataaacacattatcccaagtaagtgctaatagttcacctattctcagtgaacaagagaaggacaagtttatgcacaaatataatatttgatcttcacatatttctaaagcatgctgtatttccgttgctgtccatatttctctttccttagattcacaataaggtaaattacaatcaatgaacacatttttctttacaacttcccatctaagagcttgtcgccatgcacatcttaataattttactactgattttattgtgttaggcgatacatattgaggtgcattttttcttacaccataattcacatttttagttttagtcaatttattaatatattgatcgacatttaatgttgaaaatgattggatttttttatcacctataagtggataaacatagttattcaataaacctgtattagccttataattattaaatccccaatgctttgtaccatataactcaacaaatgtttctaaaaattctctgattgtttgattacttggagcaagaaatacttgattatttacttcatcttctatcttcttctttttaaagattgcctcttcatagttttcacattgctcccatttttgttttctttttccatcaaatgaatcaaaccaataaacaacataatattttccttttctatttgtaattgatgccattactatctcctcctatatccatattctatggaaaacattatgttttaaccaacgtgcgattatgaaaaagacaagttctactctttgagtatacttgtcaattcatttgataaacttgaattattttttattaatgaaatcatttttgataaatctatttcctttttcttaggtacgtttatatcttttaaattcacacttcgataatttgtacctataggtattatattgttattatacgataatccacttttgatatatccaatttcaaaatattctgaataatcataaaataacgttctgtaataaaaatctctaatagtcattacctcttccttatatataattctttccttagaaaagaattccaacctgctcatctttacatccggtaaattattttcatattttaatttatcaaattctttattgataatcctatcttcacacgctttaccattaagcagtgaaaaaacgaggtcattattttcatattcttcataggaaatttgatattttctaccttctacttttttccattttattagcattttggctacattaataggaatatggattttcttactattttcaattttataaatgacaagcctagtactaccctcatcatttatttttatcgttctttgtttatcattacctttattagaacctgttctttttggtttgattattccttcacttgtaagttctgctcttgctcttttaagtgtcgatttgcttatgtctaattcttctgctaaattgtagatttcatctgaataagcatcatggtcatttaataaacttataactgcttctttagcttcttcaaccaatgattttttcttattaccttttgttttttctttttgaaagtcaaaatcctttttagaagtcgttcctactttaacaatcacactatcttcaattttaaataaggttgtaggttgcaatttcccataattacttttttcctgcgaaaaataatgaataccctcatcacttgcatctcctacaaaaataacacttcttgcaatatcccaaatatcagaactatcagatgctctatttcgtccacctgccatttctcgtttatttgtgtgaacaataatgatgattgtgacatgatatattttacccaatgcaataaggttattaagagtacttctcatagtatttcttgcgcccatattaacactatcaccaataaagctttgtaatggatcaaagactaatacttctaacttattttctataattaaaccttctagatattgactattgaatttcactttatgaaatctcttatctgttattggaattgttttcacattgctttgttttgctaaattgagtcgcaacttctttttaatgatactatcatgtggatcttctgaactaaaaaaaccaatttttaaaggttctcttttatcttcttcttgattttcaaagaaacataactctccttttgataatgctgatataatgctggtccaagaggttgtcttaccaacccctccatcaccaacaatcaaagttatttgttctttaggaatatagttgggaataagccattgtatttctttttcttcaacttcatccattgaaatcatatgataatcttcattatcatcaagtaaagttatatcattaaaaactgaagtgttttttaaggtatccaatgatattttcctttcattgataaatgatatttagtttttatatttaatatatctaacatacatattcctcttttcattgacttatatccttaaaatcaataaaatgaatatgagcataaatgaaagtcattcaatgagaatccactgctaaatagttctatttgatgctttgattttttgctctttttttcttttcattgatataacgatttctaacatcatttttaatatttctaattcatctaattccaaatcattaaaactttctatcttttcaaacaactgaataaaatgaattaattctctttttaaagaacgataaacatatggattacctaatacaacataatcttgattttccatacaatgtatcaaatagtcctgcttggttaacccactcaaaaagacttttctttcaagtactctattttcttcaggtgataccctaaatgcaatcactttactacgaaaacgtccttgtttatcattgtttttatgcgacattcactatctcctctctttctatattaagtttatcagctatttctttaccttttgcagggaacaaatgtgcatatcgataagtaatatcaatactttcatgtcctactctatcggctatagctactgcactaaatcccatttcaatcaataatgatacatgactgtgacggagatcatgcaaacggattcttttaacacctgtttccttacatcctctatccatttcatgatgtaatcctgattttgttatatgaaatattcttgaatctcttttaattccatataaacgactaatgtaatcatgtatttcttcagccaagaaatgtggcatttgtactgttctattactcttttcagttttaggatctgtaatcacatcatgtcctttaattctttgaaaagatttattaattcttacagtctcttttgtaaaattaaaatcacctggtgttaatgccaacatttcacctaatcttaagccacaccaataaagcatttcaaatgcttgatatacaccatcttttctcatcattgattcagaaaattttaaatactcctcctttgtccaaaatttcatttctttacttttttcttttcccatatttccagcaattctagcaggattatttttaagattgtaatacttaactgcatgattaaatattgcacttaattggttatgaactgttttaagataacatggagaatatggattaccattttcatcacgatatgcaagcaattcattttgccattcgataatatctgctggacttatttcatttatctttttcaatttaaaatatggtttgattttatcttcaataacatatgtttttgttatcatggtattttgtttaatacgattagataaatctcttaaatagatattgagaaattcttcaaaattcatatctaaatcttttgcctgttccaatttgaattttgcaataaactcatctgcttctcttttagtgcgaaagcctcgtttcatttttttgattctttcgcctttccaattttgataataaaatgaagcataccatgtttgagtgttattatccttgtatgctggcatagttttgttcctcctttcttactccataaattctttcttcaaaatactgcctactaacacgtccacgaatagtaataaatcctttttcttcaagctctttattaagttgcttgatcaacttataagcatacgcttctgacataccagttatttcaataatatcgtgagcatccataaatgtattcatatccatcttattttcacctcctttcattaactaacccaaataagttaatctgtatattatagaataatagtaaaatcaactattgtcaagaataaattatactatttaggttagtctacttatttttttaagtttatagactaacttatttagtattattttttctttaccaatattatatattctgttataatggggacaaaaggagtgataatgatgtcattaggttcaaatttaaaaacaattcgtctatttagaaataaaactttaaaggaattaggacaaattttaggtttttcaacttcatctgctgatgtgcgtatttctcaatatgaatccgataaaaagaaaccaagagaaaatgttattgaaaatctagcttataaactagatgtttcaccacaagctattgatattcctgatattgaaacatacataggagctatttataccttatttcaactagaacgttcatacggcttaaaaattgatgaattagatggtcaacctattttgcgatttgacaagctattacctcatgaacaagatactttgtacgaatacatgcaaaattggttagaagaagccaaaaactttagagaaggtaaaataacccaacagcagtatgaagaatggaaatataattttcccaaatattcaactttaaacataaacaagcaacctcgggaagattggttacacaatcaagatgactaattgcaggattttcctgcttttttatacttacaatcctttctttaccacttacaaaatatataaatgaattatcaaaagaatagtacagtcttaaaatctgtagtatcaaaatagaatcattttcatgttaatatacaaaaaaactccgataaacacggagtttttagctttttttctactattcgaactcaattgttcctggtggcttacttgtaatatcatacattactctgtttaccccacgaacttcgtttataatacgtgacatgactttatttaatacttcataaggaatttctgcagcttctgctgtcatgaaatcgatagtattaaccgcacgtaaggcgattgcataatcataagttctctcatcacccataactcctacagaacgcatatttgtaagagcagcaaagtattgaccgatcgaacgatctaatcctgcattagcaatttcttctctatagattgcatctgcatcttgcacgatttttactttttcagcattgacttcaccaatgatacgaataccaagacctggtcctgggaatggttgtctaaatactaagtattcaggaattcctaattctaaaccaactttacgtacttcatctttgaataaatcacgtaatggttcaataatttctttaaaatcaacatgatctggtaatccaccaacattatgatgtgatttgataaccgcagattctccaccaagaccactttcaacaacatctggataaattgttccttgtactaagaaatcaactgctccaattttctttgcttcttcttcaaaaacacgaataaattcttcaccaatgattttacgtttagcttccggttcagtaacaccttttaacttttcataatatctttcttgtgcatttactctaatgaaatttaattcataatttccatcaggtccaaagacagcttctacttcatccccttcgtttttacgaagtaaaccatgatctacaaagacacaagttaattgattaccaatggctttagaaagtaaaacggctgcaacagatgagtcaacaccacctgataaagcacataagactttaccattaccaactttttctttgatcgctttgatttgttcttcaacgaaagaatccatgcgccaatcaccagcacagttacatacatctaaaacaaagttagaaagcattgttttaccatattcactatgtaaaacttctggatggaactgaatcgcatataaatctttttctttatcttcacaagatgctattggacaatcttttgtatgtgttgtaatttcaaaaccaggtgcaatttttgaaatataatcaaaatgtgacatccaaactgtagatgtttcaggaacaccttttaaaattttagattgtggttgatcaactaataaaattgatttaccatattctcttacatctgctctttcaacttttccacctaaaacatgttgcattaattgagcaccataacataaacctaatacaggaatacctaattcaaataattctttagaataagttggtgaatcttctaaataacaactatttggtccacctgttaaaatgattcctttaggattcatttctttaattttttctaaaggtgttttataagaatagatttcacaataaacattgcattcacgaacacgacgcgcaactaattgattatattgcccaccgaaatccatgacaatgactaattctcttttcatgaaagacctcctttattaaaatttaatatcttttaaaacaactgtttgttctctatctggtccaacactgaacattcttactggacaatgaacaagttcttcgattttatgaatataattttgacaatttactggtaattcttcaaaagattttacatgtgtaatatcttctttccatcctggtaattcttcataaacaggttcacatctttcaatatctttaacagttgcaggtaaaccataaatttctttaccatctaatttataagctttacagattttaattgtatcaaatccactcataacatctaataacattaatgaaatacctgttaaagaagacattcttcttgattgattaacaactactgcatcaaaccaaccagttcttcttggacgttcagttacagtaccatattcatgtcctctttctctaattaaatcacctgttgcatcatttaattcagttgggaatggtcctgatccaacacgagttgtataagctttaataattccaattgcttctttgatatataaaggtccaataccagccccttcagataccccattagctcctggatgtgatgatgtaacaaatggataagtaccataatcaatatctaacatagctccttgagctccttcaaataagacttttttatcttctcttaaatattgatctaataacatacctgtatcacaaactaaaggcttaataattttagcgtattctttgtattcttcaaaaattttttctacagtaaacatgtcttttaattcaggatattctgcaactttcattgggaaagtttcttttaatctttctaagaataattcttcatcaatgaattctcccattcgaataccaatacgactatatttgtctacataagcaggtccaatacctctttttgtagttccaatacttttatcaccttttctcttttcttgtaattcatcaatttcaagatgataaggtaaaatcacatgacaacgatctgaaattctaattttgcttgtatcaataccaccatcatttaaatatttaacttcttctaaaaatgctttaggattaacaaccatcccatttcccatgattacttcatgcccagagaaaatacctgatggtattaattttaaagcaaatttcttaccaccataaacaatggtatgacctgcattgttccctccagcataacgacatacaacatctgctttttgtgcaagataatcggtaatttttcctttaccttcatctccccacatacttcctacaacaactacaccagccataattcatttccacctttctatcattggctttttcatacatttttattatatgctatattttaatataagtaaaattaatatataatatatttgatataaggagtactaatatgataaaactagaacaatataagatatttaatgaagcagcatctaccctttctttttcaaaagcagcaaagaatttattcatttcacaatctgctgtttctcaaacaatccatgctttagaaaaagaactcaatacccaactcttcattcgtttaaacaaaggcgttactcttactaaagaaggtatgctccttcataaaaacattactgaagcccttgctttaattaccagcgttgaaaatgaactttctcattataacgaattactttcaggacagttaaatattggtgctggtgattcaatttgtgaaaattacttaattgatttattaaaacaatttcatcatctttatccaacaatcaaaatcaatgttgtcaatggaacttctattgaaacagttgaacatttaaaaaatggaacgattgatcttgcctttatcaatcttccttttgatgatgaaagtctagcgatgaaagaatgtttaacaattcatgatatctttatctctaaagaaaaagatgatcatctttacagctatcaagaaattgcgaaaaagaatcttattcttttagaaaaatcaagtaattcaagaaattatattgataaatactttgctaaacatggaattttattaaatcctgaaatggaactcggagcacatcatcttttattagaatttacccatgctaatttaggaaatgcttgtgttgtcaaagagttttctcatgattttttagataaaaataaagtttatgaaatacaattaaaaaagcctcttccttcaagaagcattggctatgcttatcttaaaagaagaagcttatcacaagcaactttaaagtttatcgaattaattgatcaatttgataaatcaatttagattcaagtttagataaagaaagacttgctttaacaagtaaaggaatatcgaaagatatttctttttctttatattttaataacacatgaacaatttcacctaatggatgttccttcaaagttaaatgaataaaaacaggtcctccattattaacaaaataatcacttaataaaaaatcacattcatttaaaatagtaaatccattaatctttttcatcacttcttcaaataaattaggattttcaacaatataatcctttaatctttcttcaatcaattcttttgtttttttcactaaaacatctgcttcatcttgatgttttgctttaacccctaaacgaattcttacatattcctctgaagcgtataaagcaatagaaacctctttttgactttgaacaatatcatcaatcatggtagctgctgccgattctccgacaccttgagttacaatatcatacgtatagattttagcttgacgatatttttctaaatatggttgaagctgatgatcaacaacatatgtcatttcttttggtggcccaggaagattaacaatcatttttttatctttagacatcacacacccattagcagttcctattggattatctaaaacataacaatctttaggaaaataagcttgtttaaagttattatccgtcacttgatctagttgtgatacaaagcaacatttatcattcacttttttggcttctgcttcattataaatcatttctaagcctaaatactttgcagataattcttttgtgagatcatcttcagttggtcctagcccacctgtagtaataacacaatcacatcctctattaaaagcaatttctaagcaatctaaaaatctttgtgaattatctcctactaccgtttgaaagaaaacattaaaacctaattccttacacattttttgtaaataagttgcattggtattgacaatttctccaagtaacaattctgttccaacattaataatttctacgttcatacacgtcctccttacaaaaaaagaagtataaagatacttctaaattaatgaaaatcctaaaaagctaaccaccatcataattacaccagcaagtaaaactcctagcataacggcaatcgttgttgatttaaaatccatatctaaaatactagctgcaagtgttcctgtccatgcacctgtccctggaagtggaattcctacaaataataataaagcaacaaaagtacttcttcctactttttcttgaagcttctttccacctctttcacctttgtctaaacaccaagtgaaaaatttaccaataactggtttatcacaaccccatactaaaacctttctagcaaataagtaaataaaaggtacaggtaccatatttgctaaaatacaaacaatataagatggaataattggtaatcctaatccttgagaaacaggaattgctcctctaagttcaattaaaggtaccattgatattaatgcaatatataaataattcatctaaaatctcctttttaacattctcattataacaaaccaaacggatttgacaacatccttttattttctacgatatgcaacttggttaaaagtatacttgtctacacgataataagtatacccatattcaatacatttaccattatgtaagcatgtaatcgataaaactctaagcaaaggtgtcactggatcgacttgtaaatattttcctagttcttcacccgctaaaaccgcatcaatttgttgatcggaaaaagcaatatgtaaattgagatcattttcaaaatgattaaataaagatgtacttgatacttctaaaggaatatctcctgttaaatcataattacagtaatcatcttcaaaacataaaggctctccgtttacaagtcttacacgtttaacgtgccatactttattatcttctaaagccatttcttttttcattaaatctgtagcttcttcaagttcatttaaaacaacatgacttgtacaatcttcttttttcttagcacagtcttctgtaacactgtttagtccatcaaaacttttaaatctggattttttacaaacaaatgagccaactttaggaacagaatagattatgttttcattgattaaatctgttaaagcttggcgcactgtcattcgggtaacaccaaaaagttcacacaaagcatgttcactttcaatttgttcattttcattatatttttcatcttcaatattttgaataatatattctttaattttgacatattgtggttttcttttcaccataacatcatcccctcggcttgtactataccatatataaacatgttttgaaaagaaaaagaagcaaatttctttgcttctaaatttcgctaccttcaaattgtgattgataaagtgaggcatagaatccacctttttctaacaattcatcatgattaccaatttctacaatatcgccatctttcatgacaatgattgtattagcatcacgaatcgttgatagacggtgtgcaataacaaagcttgtacgtccttccattaatttttccatacccttttgaataagcacttctgtacgtgtatcaactgaagaagttgcttcatctaaaataagaattttaggatcttttagaaacgctctcgcaatcgttaataattgtttttgtccttgtgaaatatttgatgtttcttcatcaagaaccgtatcataaccatcttctaaagtattgacaaaatgatctacatacgccatttcacaggcattttttacttcttcatcactggcatctaatttaccatacatcaagttttctttaattgttccattaaaaagccatgtgtcttgtaaaaccattccaaacaaacttcttaaatcatgtcttgaaaaatctttaatatcatgaccatcgatcataattgaacctttatttaattcataaaagcgcatcaacaatttaacaatcgttgtttttcctgctcctgttggaccaacaatagcgactgtttgtccagcatgaacatgcatattgaaatcatgaataattgttttttctggaagataaccaaaattaacttgattgaaagtaactgaaccatgtaatttttcaacttcatctgtttcaattttaactgtttcaggttctaattcttcttcctctaagaattcaaaaacacgttccgcagcggctgctgtactttgtaacatattcattgtttgagcaagttgggcaattggttgattgaattggcgtacatattggataaaggcttgaatatcaccaatcgtaatcgtattaccccctgctaaaaaaccacctaataaacaaacacttacatatcctaagtttcctataaagttacttaaaggttgcattaaacctgataaaaattgagatttccatgctgaatcataaagcgcatcattatattcattaaaagttttaacagaatcttcttccccattaaatgctttgacaacatcatgagcaccatacatttcttcaatatgaccattgacatcccctaaacttttttgttgtctactaaaatacttttgtgaatgtttcataacaaacataataagtaacatcgaaagtggtaaaacaagtacagcaatcaatgtcatctttacagaaatcgtaagcatcataataaagattccaacaactgtaacagaagatgtaatcacttgtgataaactttgattgagtgattgggcaattgtatcaatatcattggttactctacttaaagtgtctccactagaatgtctatcaaaataacttaaaggcattcttgacatcttcttagataaagaacttcttaaatcataagcaactttttgtgaaatcgaagatgtaataaatccttgaataaaactaaagagtgcactgacaagatagaaaccaacaagaatcaaacagatcataccaatataatcaaaatcaattccaccggtatttgttaccttggccataattccttcagataatttatctgttgcttttgctaggatctttggtcctacaatcgtaaatactgttgaaccagctgcaaaaataataacaaccgctaatttaaaataataaagttttaaataaacaaataatttctttaatgttcctttaaaattcttggctttttcaccattacctctcattccacgacccattggtccacgaggcccttgtcttcttctttcattactcatgacttagttcctccttagataattgagaataggcaatttcttgataaacctgacatgatttcattagttcctcatgtgtccctttaccaacaattcttccttcatcaaggacaatgatttggtctgcatccataatagaagcaatacgttgtcctactaataaaactgtactttttgtctttttaacaagttgatttaattcttgacgaagtttagcatctgttttgaaatcaagtgctgaaaaactatcatcaaaaatataaatatctggatttttcgcaatagctcgagcaatcgcaagtctttgtttttgaccaccagaaacgtttgttccaccttgtgaaatttccatatcaaaacgttcttctttttgatcaataaattcttttgcttgagcaactcgaatcacttcttctaattcttcatctgttgcctctggtgcaccatattttaaattagaacgaattgttccagaaaataagtttcctttttgaggaacaagtccaatacgatcacgtaattcatgttgtgtcatctcacgaacatcaacccctgcaaccttaatacttccttcactgacttcataaaaacgaggtactaaattaataagtgttgattttcctgaaccagtagagccaataaaagctgttgtttgtccaggtttagcaacaaaatcaatatcttttaaaaccggttcactcgcccctggataagcaaatgaaacatgattaaattcaacaagtccttttttactttcatctaaagcaactggatttgttggatcttgaatcgttggcttagtttcaatgatttcataaacacgattagcagcaacactagctcgaggtaacataatagcaatcattgcaatcattaaaaaggccataataatttgcattgcatattgcataaaggccatcatttgtccaattgctaaattacctaaatcgatttgtttagaaccataatagacaatgactaaagtaacgacattaaagataaacatcataatcggcataatagaagccattgatctattaacaaataagtttaaatttgtaacatctttgttggctttatcaaaacgatcttcactatgtttttcattaccaaaagcacgaataacaagcattcctgataaattttcacgcattgtgagatttaaacggtcaattaaattttgaataattttgaattttggcataactacagcaaacgcaaccgccatcacaccaaaaataacaagaataacaactgcaatgatccatgtcattgatggtgattcctttaaaactttaattaaagccccaataccaataattggtgcaaaacatacaatacgtaaaagcatcattgtcaccatttgtacttgagtaatatcatttgttgtacgtgtaataagtgacgctgttgaaaaatgattaaattcttcattagaaaagctttctactttttcaaaaacatcttttcttaaagctcgcgctacaccagcaccaacttttgtcgcaaagaaagcaactgaaattgcagccactgttccaagtaaagcaattcctaacatctttaaacctgttttaaaaatataatcggtttgtactttgtcaatgtcagcacctaattttttatattcagctttaacaccattaccggctgcaatttttaaagtactttcacccattgtatctattcttgtatccatgtcttcaaacatctttgatttttgactttcatccataaaagaaatcgcatcataaacactcatatttggaggtaattgtccaaatttttcttgatactctttactagaagtatccatactatcaagcgaagtaataattaacatcggtttcattaaaatatcttctaattcactttcttcatcacttgataaatctttcaattgataaactgtttttcctttagccttaggaaatgtatcaatgatatcttgattgactttactaacttttttataatctttttttactgttttttgatccttttgatcaacaaacaataataaatgttgataagtttcttccgttaaaacatctgaaacaggtgaagcaaatccccctgcttgaattcccactgaaacaatatcactcatataatctggtaaagttaattcagtttgtgcttgtacaaacaataaacaaatacaagcaagaattaaataccagaatttctttaaatatcctttaatcttgaacatctaactcctccttcattaaacgaatattcttttcaaagatttgacaatacgttttcattctatctaaatcttctttatttattcctccaaataagcgtgttgtaaacattttcatgccatctttacaacttttaatttcattttttcccttttctgtaatatgtaatgagacatttcttttatcatgtctacttacaactttttcaataaaacccgccttttctaaacgttgtaatcttactgataatgtagctggtgtaatttttaaacgttctgcaagtattttttgattcggatgatcaaaatgatcaataagacctaacaaataacactgatcagcagataatccttccctattgctttttttactagtaagttcttgaatatttttatggagagatttaaattgtaaaaagatttctttaatatcctcaaattccaatagatccataagacacctcctattagttagtatactaaacattatagttagcgcactaatcaatgtcaatatatttagtacgctaattatttttttataaaaaaaaggagtcttaactccttacttgtccatttccataaatcatatattttgtagaagtaatttcctgtaaaccaagtgggcctctagcatgaagcttttgtgtagaaataccaacttctgccccaaaaccaaactgtcccccatcactaaaacgtgtagaagcattatgataaacacaagccgaatctaaagactccatgaaatattttgctgtttctttattttcggtaataatcgattctgaatgttttgttgaatagttataaatatgttcaatcgcttcttcaatatcatctacaacttttatattacaaatataatcatcatattctgtagcataatttttttcagtagcttctagacaatctatgatttttcttgttttttcatcaccatagatttgtacatttttaaatatttcttgaagttttggtaagaattctggtgctactttttgatgaacaagaatcgtttcaattgcattacatacagatggtctttggatctttgcattttttgcaatttctaaagccatatcaagactagcatcttgatcaacataaagatgacaaattcctgctcctgtttcaattactggaacagttgcatttttaacaacatattgaataagccctgcacttccacgaggaataatgacatctacataatcatgggcttgaattaaatctaaagtttcttcacgcttttttgtttcaataagagtaaccgtatgtgttggtaaaacatcttgaatagcctcatttataatttgaactaaaatgcgatttgaatgaatggcttctttaccaccttttaaaacacaaacattgtttgttttaatacataaactggcaatatctactgttacattaggtcttgattcataaattaccccaatcactcctaaaggaattctgatttgttgaatcactaaaccattgggtcttttaatttctcttacaagagttccaataggatcttgtaaatcaattacttttaaaatatcttttgccatcgcttcaatacgttctttatttaataataaacgatcaaccattgattctttaataccattatttttagcttctgcaatatctttttgattttcttgaataatcaattcacttttttgaattaatgcctcagaaatattttttaaagctttattttttacttctggtttaacattttgcataaaacgacatgcttttttagcttctttaagttgttccctaatcataatttcaccccttattaatgactagattatccgcatgaatcacttcatcataatctttataatgtaaaatactttctatttcattactatgatgatctttaatcaattttaactcatcacttgaataattcgtaatacctcttgctattaagtgtcctttaaaagaaagaacatcaatgacactaccttgcataaatgaaccttcaacttctttgattcctttaggtagtaaacttgtatgtgtttttaaagcctcacatgcaccatcatcaacaatgacttttcccttaggagaactacgatacatgatccaatgatctctagcacttaaagtgcgccccgcttttccactaaaatatgttccaatttgttttccttctaataaatcaataagagctgtttcattgttgccattaacgatggccatatctcctccataatcattaacgatttttgcagcacgtaattttgtcaccatcccacctgtaccaaattgactacttgaatctttcgcaaagttcataattttatcgtccacaagttcaatatcacttaataattttgcattggaattggtatgaggattatcattataaagtccatcaatatctgaaactaaaacaagtaattgtgcatctacaataggtaatagcaaggcagataatgtatcattatctcctactttgatttcatctaccgctaatgtatcattttcattaataataggaatcacatcataatctaaaatagaagataaagcatagcttaaattcatcaaacgtttacgatgatcaaaatcatcatgatttaataaaatctgtgcacattttaaatgaaacaatgaaaataaatcttcataaatttgcatcaaatgtgcttgtccaatagccgcaagtgcttgttttttagaaatttctttaggtttttcacttaaatttaaaacacccattcctgaagaaatcgctcctgatgaaacaagtgttacttttaaccctttacgttttaaaatagctatttgttggatgagttttaaaattctttctttatctagttgtccatcttcattacacaaagaagtcgaaccaatttttataataacatgtttaacatgttctaaatttctcatgtttacacctacttttcattttttcttattatacagaaaagaaaggcaattgacaacaagtgaatacatttgaaacacttttatagctataataattttttattattatctttcatatatctagataaatgataaaatagaacatattattaagggggaaaattaaaatgaatctcattattccagaaaactatgatcctgtgttatctttaagacaaacacaagaagcaattaaatacataagagatacatttcaaaaagaatttggaagagctttaatgttagaaagaatttcagcaccactttttgttcaaaaaagtagtggtttaaatgataatctaaatggtgtagaaaaacctgtttcttttaaaattaaatgttttgaaaatgatgatattgaagttgtgcattcacttgctaaatggaaaagaatggcacttaaaaaatatggttttggtgttcgtgaaggactttatacgaatatgaacgctattagaaaagatgaagaacctgataacttacattcgtattatgttgatcaatgggattgggaacgtgtaatcaacaaagaagatcgtaatattacaacactaaaaaatcatgttaaaaagatttttaaagtcattaaacatatggaacatgaagtttggtataaataccctcatgttgtcaatcgtttaccagatcgtgtccatttcattactgcacaagaattagaaaatcaatatcctgatttatcacaaaaagaaagagaaaataaaatctgtaaagaatttggttgtgtctttgttatgcaaatcggtaatgttttacaaagtggacaaaagcatgatggacgtgcaccagactatgatgattggaaactcaatggtgacttgttattctggtacgaaccattacaatgtgccttagaaatctcatcaatgggtatccgtgtggatgaagattctttagttgaacaattaaagaaagaaaactgtgaagatcgtttaaatcttccatatcatcaagccatcgtgaataaagaattaccttacactatcggtggtggtattggtcaatcaagactttgtatgttacttttaaatcgtgctcatattggtgaagtacaagcaagtatttggcctcaagaaatgatcgatgaatgtgaaaaaaataatattcatttattataaaaaaaatctatccatgcgatagattttttatgtctaaataaataataaaggattcctacaaaaataaggaattctaaaataaagaaagcaaataacccacttataactccacaaagtaagactgtcatcaataatatgattataatataaactaaaagaaatatttttttaaatttcctaccatttcctttaggaaatgtactctttgtttctttttttatctcttatttaaaatcatcaacaacttgtttgttttgtttttgttgtttcatcttcaaaatgaataattactttttcttctttcatattttttctcaaaaaaaaagaattatagtttaaaactataattctaatgtatcactctttttatatcataaattccttgaatacgttcaagattagcaattgcacgatttaaatgttcagcatcatcaacaccaatctttaatttaattaaagctctaccatcatctgatgcatccgcatgaatatttaaaatattgattttcatttgtcctaaaaccgtaataatatcatttaataaatttgtacgatctaagccatcaatttgtaaatcagcatcaaatttcaaattagaaagtgatgcaaaatcccaataaacatcaattaaacggctttgaatttctttttgtttaatatttggacaatccacacgatgaactttgattccttgtccttgagaaacataaccagtaatttgatctccaggaattggattacaacatttagaaagttgaatctttaatcctgaaacacctttaacaacaactccattattagatgtcgttttttctaatttttctctttgttcattatttctttgtaagattttagataagttatcaaagaaacctgttttctttggatttactttttctaaaagtgttgctactgaaagatttttctttccaataaaatagaaaatatcatctaaacttcttgctccaaaagcacctaaatatgttttataagtttctggatccaagaatttcttttcatcaagtccacgttttttgatttcatcttttaagattttcttaccatcttcaatcgtatctttcttagtttcagcttcttttttagcgaggaaagtacgaattttattacgagctcctgcggttcttacaaatttcaaccaatcttcacttggtccagcggattgtttgttggttttgatttcacaaacatcccctgtatttaattttgtatcgataggcaccatgacattattgacaatcgcgccaactgtatgatgtcctacttctgtatgaatacgataagcaaaatcaactggtgttgaaccgttaggaagttcaacaatttttccttgtggcgttaaaacataaacattggcttcaaaaatatcacgagaaatggagtcataatattctttggcatcgccatctttgatatcatctgacaaagaaataaattctcgtaaccattgaagtttttctccaatttctttttgttccgctttggcagaataacctttgccttctttataacgccaatgagcagcaaccccaagttcagcaagctcatccatttcttcagtacgaatttggatttcaaaagtattaccatcttcgccaataacagaagtatgaagtgattgatacatatttggtttaggcatagcaatataatctttaaaacgtcctggaattggacgataatgatcatgaatcaatcctaaaacactataacaatcaagtttattttgtaaaataatacggagtgcataaagatcataaagttcatcaaaacgtttatgttttttaaacattttcttataaatactatagatagatttcgcacgacctaaaatacgatattgataatgattttcctttaataagttttcaacttcttccatcatcttcgccacagattcttttcgctcatcttgttttgtttgaagaagtctcgcaatatcatgataagcaattggatctaaataagataaagaaagatcttccaattctgttttaatatcgctcaaccctaaacgatgagcaatcggtgtatagacttctaaagtttctcgagaaatacgtttttgtttttctgggggcatgaattgtaatgtacgcatattgtgtaaacgatcggcaaatttgatcaagataacacgtatatctttagccatcgcaatatagattttacgatgattttcagcatatacatctgcttcatctttaaatggcattttagaaatcttcgtaacaccttcaacaagggtcgttacttcttctccaaattctttcaccatttcttcacgtgatacatcacaatcttccatgacatcgtgtaaaagacccgctgtaatggtaagtggtcctgtttgtaatgttgataaaatataagcaacccaaatcaaatgaattgtataaggttctccacttttacgtttttgtccttcgtgtttaaccatgatataatcataagcttttttaataagcttcatatcatcttcattggtaatatagcgtctacatgattcatagacatcttctatagtgactttatctccagcttttttaaactctttcatattataaccccctcatatgataaaagagagtttcctctcttttatttaataagttaatactgaatagacattatagtcttttaatttttctctaccttttagagcttcaagttcaattaaaaaggcaattcctacaactttaccaccaagttgttcaacaagttgaatagttgcttcaactgttccacctgtagcaagtaaatcatcaataataacaacattttcaccaggtttgatactatcagcatgaatatgaacttcattttttccatattctaaatcataacttgctgaaactgtttctcttggtaattttcctggttttctaacaggtacaaaccctgcatttactttgtaagcaacaggacatccaaataaaaaacctcttgcttcaggaccagcaacaacatctacttgaactccaagcccatcgatccatttagcgaatgtgtcaattgattctttataagcttctttatcttttaataaaggtgttacatctctaaaaataattccttcttcagggaaatctttaatatcttcaatatattttttaaagtccattttatgtactcctcctatttctattataacaaacttttattatcaaggaaactatttcatatcctctataatcatatttattgattctgtatttaaatatttattaatttttaaagttcctattaaagaaattgtctttttttgttgtaattgctcaatttcattcgaacaattaaaataaagtgcttgtaaattacctttatttaaaggaatatcgaaacgtaaatgtttcccatcagataatacacgactggtaaaattcgtaatatcttttaaaacaaatttcatttcttcattacattgaccatacggctctaacaattctaattctttaacagctggtaaagtaagctcatttaattcaatttgaattccttcaagaactttttcattagaaaaagtatgtgttgttaagtagatatgcaatgcttcttttaaagttaacacttcatctttagctacttgaaaaccacccgctaaagcatgtccaccatattgtacaaaataatcttttaaatcatcaaaaatttgatttaaaggaatactttcaatacttctagcacttcctcgatagacttcattttttttatcgtatttcatcacaaaactcggcttttgaaattcatgagtatacttaccagcaattaagcctacaattccttcatgaacttcttgattatagctatataaaaattcatctttttgactattttctaaaatatttttgtattgttcatttgtaagagattgtcttttactattgatttttttagcgtattgagaaatttggattgcaaatttttgatcgacatcctttaaaaaataatgtactaaatgatttggattaacaagctctggtagtcttccaaaggaattgatcttaggtgcaatattaaaacctaaagttgttgtattatatttttgattttcaccaattaaaagttctaattgaagatatttttcttcattcataaattgcagacctcgcgaaacaagcgatttattttcatcaactaaaggcatcatatctgaaatcgtcgtaatagctgctaaagaaaataaatatttatcatgttttccaagcaaactactggcaagtttatacgctaaaaaacctccacatatttctttaaatggataatccggtgacatttttgtatgaatgattgcacatgcatccggcaattcgtcataatcatgatgatcaataacaataacatcaataccaagttcattagctaaatcaatagcttcatacgctttaataccattatctactgtaattaacaaagaatatcctttttcatacatttgttgaactctttctttatttagtccataaccatcttcaaaacgattaggaatatgataccctactttttttcctaattctaaaaaagcttgaacaagaatggctgttgacaagattccatcacaatcataatctccataaatacatattttttcatcattttccaaagcttcttgtatacgatctaaaactaaatccgcatctaaaaacaatgaaaaatcatgataaatcaatctttttgaagtatgtccttgaacatcttgttcattatattctctttgtgcaaaaatctttgcaagtaaagaatgtattgaatacttttgcatatattcattatagttatgtatttcttttatatcccagttcataaaatctccttaaataaaaaatagttgttaccaactattttgaaatgaattcttgaaatgctgctaaatcgagtgtacttgcttctttaactgcttgtatacttaaataatcaaaaatttccgaaaattgtaaattcattacatcatcaataatatcacacattggtagactcttttgagatttccatttaatattgaataaataatttcttatttctttttcggatatattatctattttttgcttacgaaactcatgagcttttaatttgattagaaaatctaaatcatatttaccaaatttataatccagtttttcattcatgataaaccaactcccacttcgtctattatagatgaaaattcgacataaaggaagtcttttatgaaaagaaaacttatcaattcattcattattctttctgctagttcagctatctctaaaatatttagtattttaaatagaatgttactttccaggcttcttcctttagaagccatgtcattatatcttgtcattatgccaacactttctttgtgtttaacacttggacaggttgggattccttctgctgtttttcgtcttacattacatccaaaatataaaaactacaaagtcattattaccgcaattattctatcctttttttctgtcattgttatttgtggaaccctctttattttaagtcctttcattgctcattctttattaaaaaacgattatactctttatcccattttatcctttttaatttttattccattgattgctatcagtggtattattaaaaactattatttagccaaagggcatgtctatgtcattgctaaaagccaaattgtcgaagaaacttcacgtttattatttacctatttatttttaaaaactcctttaagttcatccttaccttttttagtaacaatcgcttatttatcaatgagttttggtgaattgatgtcaattatctatctacttcttttaagtcgtaaaagatattcttttactcctttaaaaaacataaataagcaaaacttgattatgaaagatcttttaaacatttctttgcctttaacaggttcacgactttaccattgttttatgaattttttagagcccattcttttaattcatgttttaactcgacttggtttaactcaaaactttatccaagaccaatatgccatcctttctggctatgtcgtctcgatgcttgtcacgcctacttttttttgtacgatcatctatcgcctctatttgcctattgctacagatgatctttattatcataaaagtaatacttttttacatcttctttatgctttacttatttgttttcttattggtcttccttttactttaattttctatttctttccaaaacgatcccttatgattctttacaatacaacaagtggctatcaacaattaaaatacatgtcttttccttttttactattttatttacaaacacccctttctacaattttacaagctaaaaataaaaataaagtgatgtttatcatctctatgattgaatgtactttagaaattatcttaacttatactttatctcattatctttatgttaacgctattttgattagtttatttacaggattgattacaaccttaactttaagtgcaatttattgttttaaaataataaaagacacttctttatcttgaagtgtctaatttttttaaccaatttgaaaatacttctaaaccttctttgacaatttgtgaatcatttgcaagtccaaaacgtagatgattttccacatcaaagcaacatcccggtacaaagaagacccctgtttcttcttgtaacttttcacagaaagtatttgaatctattttgtaatcatattttaggaaacaaactgttccatattttggaataacacaagaaagatgaggatgagcttttaaccattctttcaagtaacacttattttcttctaaaatctcacgatttctttttaaaatttctttactatattttaaagtaagtgcccctaaataatcattgattggtccactactaataattgaataatcacgtctttcattgattaaacgaataagttctttatcttttgttttgatccaaccaacacgaagtccaggagttgataaaactttagaaagtcctgaggttgctattcctttttcataaagatcactaatggattcttcttgataaagtcctcgatagatttcatcaacaagaacatagagatcatgctttttacatatttgaatcagttgatgcatttcttcatgatctaaagttgttcctgttggattgtttggtaaattcaaacaaatcattcttgtattttctctaatatttttttctaattcttcaaaatcaattttccattcattttcttcttttaaatgaataaaatcaacttctacccctaaagattcaggaaaactataaagttgttgatacgttggtaaaaatgataaaatatgatcatttgttgaaagtaatgtcattaaaacaagttcattggcattgacaccaccatggcaaatagcaatttcttcatcatcaccactttgatataaacttaaaatacctttttttaattcatgagaaccttcaatagcaccataatctaaagaaagattcattaaatcttctaatgaatcttttttatcatacgctaataattcctttaaagttaaagatttagcaactgtatctgccaagttatagcgacagttattttcatgcaaagtcatataagactctacttcaaaacgttgtagtttcattagtgcataaccttctttaagaaatcttgagcacgttcagttttaggattttcatagaaagcttttgcatcattttcttcaacgattttaccattttctaagaaaataacacgatctgcaactgttttagcaaagcccatttcatgagtaacaacaatcattgtcattccttctttagcaagttgttgcataacttctaatacttcaataaccatttctggatccaaggcacttgttggttcatcaaaaagcatgatttcagggcttgtacataagcttctcgcaatcgctaccctttgtttttgtccacctgaaagtttatttggatactcatcttttttatctaataaaccaactcttgtaagatagttacaagctatttcattggctttttcttcctccatgtgacgtacttttgtaagtgaaagtgttaagttttctaagactgtcatatgtggaaataaattgaaatgttggaaaacaaatcccattttatttcttaattcttgataattagatttctttggatctaatacttccccattaaggtatacatgtcctgtttctggtacttctaaaccatgaatacatcttaaaactgtactcttacctgaaccagaaggtccaattaaacacacaatttctcctttttttacttcaagagaaacatcatcaactgcttttacttttttaaattgttttgatatatgttcaactttaatcactttcagctaacctcttttctacatatctacctaaataagaaatactaattgtcataattaaataataaactgcaacaatacaataaggtgacataacatcataatattgtgcccccactacttgagctgattttaataattcaacggcaccaatacaactgatcaatgaagaatctttaatcaatgtaataaattcactgatcattggtggaataattcttttaaacgcttgtggtaagataacaagtctcattgtttgtttatgagaaagtcctaaagtttcacaagcttcccattgtcctttatcaactccattaattccactacgaattaattcagttgaataagccccactgttaatagacatagcaacagcaccaattaaaaagacattaattcttaaaacatttcctgtaaacgctgtataaatagatggaataactgagaataaaatcaagatttgaagtaacattggtgtcccacgaatgacttcaacatacacatttccaataattctaaaaattttatatttagatctttttgctgaagatcctaaaatcccaaaaacaataccaaataaaagggatacagcagcgagtaaaagtgatactactgcacccttagcaaagtaaagtaagttttcaggagtaaacacttttgaaaaagctacaaacatttctataccccttttctataattttttatttttctaatggtgataaatcatattttttacataatttatcgtaatcttttgaagctacgaattttttaatacatttattcattaatttgatcatttttgtattaccttttttagcgataacatagttcttttcatccattaatgaaccatttaattgtgtaaagtttccactagatacatattgttgagcaacacctaaatcaacgattgctgcatcatattgattacttgctaaaccattgaaaatatcttgtacgtttttcattgaaacaacatcagcattttcaacttctttggcagcttgttcaccagtagctccagtttgagcagctaattttttaccaactaattgatcatttgaagtaattgaagaaccatttggtacaacagcaacttgttgagttcctaaatatggatcagaccattcaacaactctatcttcactataagtaaaaccagaaatacccaaatcaatttgatccccttgaatttgagtaacaatgttatcaaaatccatttgtttgaattctaaagaataagttttaccttccatatcagataaataaccttcaaataatttggccatatccacgtcaaaaccaacgatttcaccttttttgtttaatgattcataaggtgcataatcaggtgatgtcccaattgtaattgtcacatcggcatcatttttactgcttgatgaacatccagcaatagcacaagtcatcacaagtgctaacattaattttaatacttttttcatattcttttccccttttctacccaataaaaaacgtctcctagcaattgctaagagacgaaagattccgcggtaccactcttgttgatatgataaacatatccacctcaccgttaaagctggttagcttgttatcctatgtattcagataaccccctccaaagtgcgcttcattttattttcaatatctaatttccaccaacatagactctctaacatatccaataaaactactctctttttcattgagtttatttatatacctgtattatagataatatttaagctttgtcaacattcctcgattatttttttgataaaactttttcattaaaagaacgtactgccttcattgctttttctaaaggagcattcatttcttgtaattgttctaaaacatcatcgagttgttgattggtttcttgaatactgtctcttgtatcttgaactgtttgcttggttttctttttggcatcaccactatgaagtaaaaagaaaatacctaaagacatacatacaaaaataccaataatgattaaaaaatctttaattagttccataatctcacccatctttagtatagcctattttgtttaatcaatccagccaaaatgacgacaagcatattcaataccgtcatcatcatttcttttggttataaaatttgcgactgctttgacttcatcgattgcattacccatagcaatacctaaaggagcttggtcaatcatagaaatatcatttaagccatccccaaagaccacaatatccttttcgtttccctttaataaatgaaccatttctaaaatacctttatatttatctgctggttcgatgatgatttgtcctttaaaataacgcatatattccaaagttcttaaatccaataatttttcttcttgttcactacattcaataaaaaccttataaatttcctttacttgatgaaaatctatactttcatcaacaactaattttaccggaagtttttgatctttttgatcactttgattcgtatacaaaacagcttcatttcctaaagcaactgcaaatgggaaatgatgttcaatacattgatcaatgacacgattggcttgaacaaaatctatcggtttaatatattgaagttcattttgtaaagtaataccatttcccccatctgttactaaacaatcaatatgggcttctttagcagcatccatcgccatatattgtgctcttcctgtcgcaatagcaacaaaatgcccattttcttttaacttatctaacgtacgatatgtgctttctaaaatctttcctcctggattatcatctaaaagtgttccatcaatatcaaaaaaaatatattttctttccatgttacttttctcctttaaattgcatattatataatcttgcataatttccatttaatttcatcaattcttcatggtttccttgttcttcgatgccattttccgttaaaacacaaatatgtttggcatttttaatcgttgataaacgatgcgcaataacaaaagttgtacgatcttgagataatttttctaaagattcttgtacaatactttcactttcattatctaatgcacttgttgcttcatcaaaaataagaattggtggattctttaagaaaacacgtgcaatcgagatacgttgtttttgtccacctgaaagtttgactccacgttgtccacaatccgcatcgtaaccttcttctaattccataataaaatcatgagcattcgcttttttagcggcttcaatgacttcttcatcactcgcttctaaatttccataacgaatattatccatgatggttcctgtaaataagtaaacatcttgttgaacaatcccaatattttctcttaaagattgttgtttgatttctttgacattgattccatcaatcaagacatttcctttcgttgcttcgtaaaaacgaggaatcaaagaacaaatcgttgttttaccaactcctgatgaaccaacaaaagcaatatactctcctggttttacatccaagttaatattatttaacacataaggtgtttgttcattatagcgaaatgaaacatgatcaaacatgacattcccttcaacatgttgtaatacaactgcattttttgtatcttgaatatctggttcaatttctaatatttccataaaacgttcaaaaccagtaacaccttcttgaaattgttcagtaaagtttaaaagtttttttacaggatctattaagttcgtgacataaagtaaaaaggcaattaaatctgcaacattaatacttccataagaaataaataaggttccaaaaaagataaccgatactgtaattaaacttgtaaaagaagtaagtcctgcattgtatcttcccatataataataactatttttcttagcacttacataatgtccattttgtttatcaaaacgttctaactcttgatcttcattcgcaaaacttttaacaacacgaattcctgataaattgtcttcaatgcgttcattgatatcaccaattctctctttatttcttttaaaagctgttttcatctttttattataataccaagcaaataaaaacataaatggtaagattgcaaataaaattaaagtcagcttaacattaatataggaaagtaaaataaaggcccctataaacttaataattgaaatgacaatatcttctggtccatgatgataaagttcagttaaagaaaataaatcattcgttagacgtgacatcaattgtcctgtgttttgttcatcataaaagcgaaaagataatttttgataatgactaaataactcattacgtaaatctctttccatatagacacccatgacatgtcctagataacctataaaataattacaaaaatattcaacaacgatcaaacaaagcataaaaagtcctaataaataaattttagaataatcaatttttggttgatttaaaatcgttcctgtaatatagcgtgttagcatgggataaacaagtgtgatagctgctgaaaccatcgcacaaaacatatctttaaaaaacaaaaccttatagtttgtataataagataaaaatttcttccatcttcctttcatataaaaacacctccttcatatatttttacaaagaatgattattttttctagttaaaaatgattatttttaaaatatgaaaaaggaggctttttcatgaaccaagtttcttggacttctattctaatcggtctggcactttttttatttggtatcgactatctttctctttctttacaagaactttcaccaacccgtttaaaaaatcttcttgctaaatgtacttcttctacttttaaggctattctaattggttgttttataacttgtatcattcaatcaagttctgccacaactgctttaacagtgagtttaatcaatgcaaacctcttgaccttttcgcaaagtattggcattattatgggagccaatattggcacaaccataacagcgattattgtaggttttgatctttttcaatatgtttctttctttttgattattggtgctttttgtttattattttctaatcatcctaaaataaaaggccttgcacaaattctttttgggcttggttgtttattttatggattagaacttatgtcaatgcatcttgaagctattactaaacttcctgaatttatgaaattagtaacactttttacaaatcatccaattctagccatgtttggtggagccatcacaactgctcttattcaatcatcaagtgccatgattgctattgtccaacaaatgtatcatttaaaagccatttccctttatgtttctattccttatatctttggttgtaatatcggtacaaccattaccgcttttctttctgcccttaaaaccaattcatctgccaaaaaagccgccctctttcattttctcttcaatgtaattggaactactttttttatgattttcctgactcctttttatcatctttttttaacatttcgcttttatattcctatttcacctcgtctgcaactcgcttttattcatggcttcttcaatattgttactacactccttatttttcctttttataagcctataattacattgattgaaagttgtttcaaaaagaattgttaaggttttgtaaagaaacttaacataatctttacacaaatttaacattcctttaaaatgagatgtataggagtgtgattttatgacattagcagatatcaactggcctttaattctggcagggcttggcttatttttatttggtatcgattatatgggtgatggtttaaaaagttatgccggagataaattaaaggacattattgataaatacacctcaagtcctgtaaaaggaattttaattggggctttagttacgtgtttaattcaatcaagttcaggaacaacagcccttacaattggattgattcgttctggtttaatgaatttaaatcaagcagtaggaattatcatgggggccaatattggaacagttattacttctgttttagttggtttaaagatttctaaatatgcggtttatttcattattattggtgcgtttgtttctatgttttctaaaaataaaaagtcaaaatacttatcacaaattatttttggatttggttgtttattctatggattagatttaatgggtaacaatttatcaatgatttctgaagttccagaatttacacaaattacagaattcttaatgaaaagtccttggcttggtttacttggtggaacaattcttacatgtgcgattcaatcatcagctgcaacgattgccattgttcaacaaatgtatggtgccggcgctattggtttaaatattgctttaccatttttatttggatcaaatattggaacaacgattacagcggttcttgcctctattgggggatctattcccgctaaaagagcagcgttcttccacgttttatttaacgtcattggttctgttttatttatgattgttttatcaccatttacaatgttgattcaatatattaattcagtaagtaccatgtctcctgaattacaacttgcagtagctcatggtatctttaacatagtaacaaccatcttgttctttccatttattaataagattgttgttattattaaaaaaatcattccaaatcattcaaaagaattacaaatggatttatcagaattagatcctcatgtggttcaattgttcccttctcatgctttagctatcgctaaaaataagattttagaaatgggtgctattactgttgaagcttgtgaaaatgttaaagaatactttatttctaaaagttctactgcaaaagaaacagttgaagaattagaaaatgcaatcaacttattagataaaaagatttcagaatacttattacttatttcacacgaacaattaaacgatcatgattcaaaagaatattttgctgatatgaaatctattaaagatttagaacgtgtcggtgatttatgtattaacttaactcaattctttgaagctgtttatgatgaaaaagatgatttttcatcagaagctaaagatgacattatcgccatgatcaatatggatattgaaatgttgaatcatgcaatggttgcttttgataaacatgatttagatgatattatttatgttgatgatcatgaaagtaatttagattattataataaaaaagcaaaacaaagacatattcaacgtgttactaataaaactgaaaaatcagttattgtcaattctacatacgttgatatcttatctaacttagagcgtattggtgatcattgccaaaacattgctgaatcttatatgttagaagaagaaaacttcaaaccagattatgaagttgattctgcatttaatcaatagtcatggatttccatgactatttttgttatgatgtaacagtcaaaggagtcacatatgtataaattattagattatgatataactgaatataaacaattagaaaatactttaaatgagttatctaaacaaggttacaatcctacttctttaggtaaaatcagccgttttgaaaaaaatgagaaacactactacttccatgtagatttactaatcaaaaaaccggtaacccctaaaagaaaagcattacatgattttattaatgaatatgaaaaacaaatgtttgattattatggtaaaataggaaaatttattatttttacaacagataataaacgtgctttacctaaagaaagacaaaaagcaattgatgaatacttaagtactcgtaaaatctctgtaaccacttattttgttttatggattttcttttctttttttgtcgcacagcttgttttacaaaaaaatcaaattcaagaatttcttacaaatggaagtattttaattcattacttacctcttcttctctttgcgacaattcttattcgttgcctttataaaattgttttagcctgtcaaaaaagctttggaaagattattaaacatatcttctacgctatgactatagttacttgtgtagttgctatacttggatgtattttagatattactgatagaaaagatattcctttaaatcaaaatattttaacattgcaaacatttgataaagaaacaaatttaaaaaaatatccaaactacaaatatactaaaagttttattgttgaatctacttcttattttgaagaaaacaaccaaggtgatctcatgtatagtaaagattattgttttaaatcaactgacaaaacaaacactttctttaaacgttatttaaaaacgtatgatgatgttcctgttattaaaattgataaaaacacttatctctttaaacttgatacatcgtatgatactttactgtataaaaaagaaaatcatttctattttgtttctgcaaatttcagtttaaaaaatgattatcaaaatattattgagttttataaataaacaaaaaatccaccccaaagtggattttttatttacctgtaataataagatagataagaagtaaagcaataataatcattgttgaaataaggacacgtctttcaaattcgctataatcatcatgataaagatagtgtgctaaatagttaagaactaacgctataagcaaaaagattcttccaaccataaaataagacgtattcatcaccaccggttcaataagcaataaaacatcaaccaaattgattttatatttatgatgtggtttgcaaattttatacagtaatttcttcattaataaaacgtactcacttcttctattgtttttctttttggcatacttggttcaatatttggataacccacacctataacagaaacaatcgtttcttgtacaggtatttctaaaagttcacgaatcgctctttcatccctgattcccataacaagtgttcctaaaccaagttcagttgctttaagaattaagttttgattagctaatccacaatcataaacaccccaaccattttgtaattcgttgtcaggacttccgtttctttgaaaacctgcacgatctttaacaaatgttgtcacaattaaaacaggtgcatcagctatatttttttgattaaattcaggtaaacattttttcttaaattgttccaacatttcttttgattgaataacatgatatcgtggtgtttgactatttttccaactttctgaatagatagctgcttgaatcatttcttcaattttttctttttccacaggttgttgtttatatttacgaatacttcttctttgttgtaaaacattttgtaactccataattttcactctcctacttttattataaaagaaaagactatcgaatgatagccttacttatttaattcaatcataagctcacaaatcttatttgaaaaagccactggatcttcaatagataatccttcaatcaataatgcttgatcgaataacaatgaagcataatcattgatcttatctgcattattttgataaacattttgaattgccttgaaaatatcatgatttggattgatttcaagaattctacctgctttaacatcttgaccatcaggcattgcatttaatactttttccatttcaaaagatacaccttgatcagatactaaacatactggatgagattttaatctatttgatactttaacatccactactttatcttttaaagcttcttttaatgattctaataatgatttattatcttcattgatcttttctaattctttcttttcttcttcactatctaagtttaaatcaccttgagcaacgtttttgaaagctttagaatcataatctctcatcatttgaatcatgaattcatcaacattatccatcatgtataaaacatcaaagtcacgatctctaacagcttctacttgtggtaaatgagaaatcttttcttttgtttcaccacttgcaaagtagatttctgtttgtccttctttcatgttttcaacatattcttttaaagtaatcattttttcttctttaccagagtagaataaaagtaaatcttgtaatttatcttttaacattccatagctttgataaataccaaattttaattgtaacccaaagtttttaaagaatttttcatatgtttcacgatcttttttcaacatatttgtaagttcactttggattttcttttcaatacgatcagcgatgacttttaattgacggtcatgttgtaacatttctcttgaaatgtttaatgataaatcttgtgaatctactaaacctttaacaaatctaaagtgttctggaattaaatcacttgctttatccatgataaagacacctcgactataaagttgtaaacctttttcataatcatttgaatagaaattcatcggtggttgacttggaataaataacaatgcatcataagaaacatttccttctactgatgtatgaataactttcattggatcagagaaatcattgaatttatctttatagaattcattatattcttcatctttaatatcttttttatttcttttccataaaggaaccattgaatttaatgttttattttcaacgacatcttcatattcatcactatcttcttttttcttagatgttgtcacatccattttaattggataatgtacataatcagaatattttttaacaagagattcaatatgatattgatctaaataatcatcataattttcttcttctgtattatcttttaaataaagtttaattgttgttcctgttggtaagttatctgtttcaaagatttcataaccatcacttgcttcagatacccaagtatatccttgatcactaccataagctcttgatgaaacttcaacttttttagctaccataaaggctgaatagaaaccaacaccaaattgaccaataatatcaatatcatcactttcattttcatttttaaatttaaatgaaccactattagcaatcgtacctaaatgttcttctagttcttctttattcattccaataccatgatcagtaacagtcaatgttctattttctttatcaaaagctaaatcaattgtaagatcacttttattgatttcagaaatattttctgttaacgctttataataaagtttatctgttgcatcacttgcattagaaatcaattctcttaaaaagatttccttatgtgtatatatagaattaatcattaagtctaataatcttttcgattctgctttaaattgttttttttctgccataatatatcctcctttagcactcctgtcgtttaaatgctaaagatagtatattactttgttttagcatagtcaagcacagagtgctaattttttaagaaaataaaatgattgacttacaatcatttatttcgactacatttttgagcatctatcgcaagaacaatcattaaaacataaaaagcatcttcgtcatgttctattgttaaagaatatgtatcactcatatgaaagatttctttattaattaaaccaataatatttcctgaataatccacgatctgataatcccattcccaaaaatttccttctatttgccaatctttataatctaaaataaatttaggtttaaagaaagtaaactctttggtaattttaccaatatattcatcattttcatataaagcaaaacgtggtaaaaacgttaatatttcttctttgatcgtaccaagatgttcaccatacttattataaataaaaagtttatgtccaaaactgagttgtcctttcactgtatagacagtttcccccttttcatcatatatatcataactgtctagccatgaaaaaatacgctgtttaaataatagtttcataagattccctccaatttttaataatgtctatttcttcttgctttttcaatatctattacagttgttaaaatgacgaaatttaaaatatcttcctttaaatcaactgaaatatcatatgtatctaaaatatttcataatcttttttcaactcttccaataagataatcattttcatcttttacttcataattatattcaacatattctccaccaacattccattttcgataatccactaaaaaataaggaataaaataagaaaactctttttctacagcactaatatattcctcattttcataaataaaaaaacagctgatctaggattttcttcaatcttagcaacaatattttcatgagcatcatatatataaagttgatacataattgccatttttctttttataatataaaacaattcattattttgatttgttacataaaagcgaaaaataaaagatggttgttgtctaaataacagcttcatagaactcaccttttatccatattgtagcaaaaaaacaacaaaacaagcaaagcttattttgttataaaaattataagtatttaactgtttcagccaattctttttttaaatgatgattaggaagtggttctttttgatttccatatcctaaattcaacatcataacaacttcttcattttcaggtaaatctaaagcttttttcatttcttgaggatcaaagaaattgatccaacaactatcaattcctgcattataagcagccaacattaaatgagtggctacaatggtagcatcttcaattcctgaatttctttcattacctggataatcaaaaaacattgtttttatcataagctacaactaaaacagtaggtgcatgacaacgacaaggtgtacatgcatctattttatctaaatattcttttgattgaacaacatagattttttgttattgcaagtttttagccgttggagcaactcttcctgcttccaatatttccattaatttttctttttctatttgttgtgtagaaaaatctttacatgaatatctgttttgaataacatctttaaattccataatatatctccttttttattttctaataaatatattaaatatttgagtacatttggtaaagaaaaattatcaaatacttgatgttctctatagaaaaaagtttactaaataactttaaaaatttttcttactttcaaactctcctcttatcatgttcttactttttattggtttaatttctatataaaaagccgtggagcttcaaattttacgtaattggaacgaagtcatccacgacatatatataatagtatatatttcaacttaacaaaagaaaaaactgttgattttttatttttttcaacagtctaaacaaatcattttatttgatttgcttttttacttatatattaacttattaattaatgatttttaaaacatcttcttcatttgtaatattaaatatattacgtgttaatatatttagtttttctaatgttgcattggttagttgtaattctagattatttgaaatagttcctagtttgatttctaattgttcttttagtgtacttctcttttcttcaagttttccttcacttctaccttcatttctaaatccttctgccattctttccattccttcacacatatcgatttgaattatctgtccaataacgatctatgtagttccaaaaaatattaacagcttcactgtccattaccgaagttacctgtttcccgttaacataagccatataacctatttcattaggatcttgatcttcatagtaaacaaataagaaagtatcttcgttatcaatgttttgttcataccagttttgtgcataattatctttttgactatcacttgtaagtgtttcatcatagctctttaaataaatataaggttgaattcctgttttgttatagaaattcttaagatttttagaaagttttgatgtgttttctacataacctagttcatctttaatgcagttattatcgtaaggaataggattttctatcttttcacgattgattgttgatgtaacgtcactatcatcactagcaatcataaaaaagctaaaaataacaactgcgaaaacaattaaacaagcgatcaaagttcctaaaccacttgaagaactagtataaacatttcttctatatccataatagcctcttcgaggaggtggtggagtatgatgataatgatgcatagagggacctctgttaaaagatgagcttcctgtaggacgacttgatctaccaacatgatgtccgcctccaacacgactacttgaatgcccgccagaagaacgatgtccaccactgctagttccaggtcttggcatattttcacctcttttcttaatattttattataataattataccttaattttctatgaaaaaatagagataagataaaaataaaaaaatgaataaaagagattgacagtatagttagtctatgctaacatatagttgtggttagcgaaggataacttgcagaaggagtaaagagctatgaaaaataaattcaaacgcagcttgattgctctggctttacaaatgagtgtcatcgttgctgcaatattattcgtttaattgtcttatgatttatttaacttaaattagccaaattcctttttcctatcataagattattaagtgaagcaaaagtttggtaagattacttacctttttttgtttatataataaaaaatagctcgctgagctattttttcatatgttctttaattttattcattgtttcatcagaaataacatgttcgatacgacatgcatcattaacagcagtgtcatgagatacaccgatactttcaaaaaatgaagaaagtgtatcatgacgatcataaattgttgtagcaacttttaaacctttatcagttaattcaatatatcctttactatcaacaataatatattcatctttctttaataaaccaatagcacgagagacactcggtttagaataattaagctcatgagcaatatctatggaacgaacatccttatttcttttagataaaacaagaattgtttctaaatacatttctcctgattcttgtaagttcatgtgcatcacctctttgcatattataccatatttttaacaagataagcaatgaaatcactttgctaaatcaagaaagagggttgacattgataacgaaatgcagtatattctatttgaagttagagaagtctaactatattttatgtcttatagttagcgaatactaatcaaattagcataacctaatatggttagcgaggacaaattcttgaggaggtaagtaagatgccgttaacaatgttaaacataggagaaaccggtgaaatcaaaagaattggtggtaacgaagaaacaagaagatttttaaataatcttggttttgttgttggtgctgaagttgttgttgtttcggcaatcgggggaaatgtgattgttaatatcaaggattctcgcgttgctattaatgaagatatggcaaaacgtatcatggtgtagaaaagggggaagtgttgtgaaacttaatgaagtagaagttggtagcactgtcactgttaagaaaattgaaggtgatggagcttacaaaagacgtattatggatatgggtatcactaaaggggtagaattatacattagaaaagttgctcctcttggagatcctgttgaaattactgtaagaggttatgaattatcagttagaaaaaacgatgcacaatgtgttgaggttgaataacggaggggaaagttaaaaatgaatattaaatttgcgcttgcaggtaaccctaactgtggtaaaacaacaatgtttaacgcattaacaggtgctaatcaatatgttggtaactggccaggtgttactgtagaaaagaaagaaggaaaagtaaaaggaaacaaagaagataatattactgttgttgacttaccaggtatttactctttatctccttatacattagaagaagttgtcagccgtgattttcttttaaatgaagatccagatgtcattattgacttagttgacgctactaatattgaaagaaacttatatttaacaactcaattgattgaaactggggttccagtagttattgctttaaatatggcagacttaattgaaaaaagaggtttaaaaattgacactaaacgtttatcaatggtattaggatgtcctattattgaaacttcagctttaaaaggaacaggtttaaaagaattaattgctgaagctgttaaagttgctaaacaaggtgaacatcaattacctcaatctatctttagtgaaaagattgaaaaagcaattgatactgttgttccagcattatctgaaacaattacagctaataagaaaagatggtatgctgttaaagttttagaaaatgatgaaaaagtaatgaatcatattgtattaagtagtcaaaataaaacaacaattgattctttaagaaaagaattagaaactgaattagatgatgatatggaaagtattattactgatggacgttatacttatattcaaaaattaatttcaacaactgttgaaaaaccaaaagaaaaattaacaatgtcagataaaattgataaaattgttactaacagattcttaggaattccaattttcttagctgttatgtttgttgtttactatatttcagtaacaactatcggtacatttgttactgattggacaaatgatgtcttcgttgttgcaattcaagatgctgtatctggattcttaggttcagttggcgcaagtagtttattaactgcggttatcgttgatggtattattggtggtgttggagctgttattggattcgcacctcaaatggcaattctattcttattcttatcaatcttagaagattgtggatacatggtacgtattgctttcgttatggatagagtatttagatatttcggtttatcaggaaaaagctttattccattattaattggttctggttgtggtattcctgctattatggcatcgaaaacaatcgaacaagataatgatcgtcgtttaactattatgactgcgacatttattccttgtggagctaagttacctgttattgctttattaggtggtgttatggctggtaaagttgctggttggcaagctgctggatttattgctcctgcaatgtacttcgtaggaattgttgcagtattagttgctgcgattatgttaaagaaaacaaaacctttctcaggtaaacctgcaccattcgttatggaattacctgaatatcatattcctagtgcaaaaactgtattattacatgtatgggaaagattaaaaggattcttaattaaagctggtactattttagttgttgcttgtatcgttatttggttcttatctacatttggatttgaaggtggatcattcggtatggttgaagatactgctaacagtttaattgctgctattggtgatttcatcgctccaatctttgcacctcttggatttggtaactggcaatctgttgcttcttcattaactggattctcagctaaagaagcaatcgtttcaacaatgggtgtattagctaatgttgctggagatcctgaagatgctgtaaacgttgctgctggtgtagctaaatggttcccaacaggaatggctgctttatcattcttaatctttaacttattagattcaccatgtttagctgctatttcaactatggcaagtgaattaaatgatagaaaatggttctggtttgcaattgtattccaaaacgtatatgcttattgtatctcattaatggtttatcaaattggttcattagtattatatggaacatttggattctggacagttgttgcgttcatcgttctagcattcatgttattcatgttgtttagacctgatccttataaagatcaaaaagtttattctacaagatcagttgaagcataataaaatccggaattattccggatttttataaattaaaggaggtattattatggctaatgtgattattgttttattaattgttgcctattgtgcatgggtcatctatacacatttctttagaaagaaagatggacataagtgtagtggtatttgtgcagggtgtagtcaatgttcatctcctttagatgattattatagagatcaaaagaaaatgaaagagagacataatcatgggtaatgtaagtggttcgactttctatatgtttttaggagtacttgttatttatttaataggtgtttctatttacacacttgttcaaaaaattaagaagaaaagaaaataacaggaggtaattatggctaatgttattatcgttcttatattagttgtggttgttggtattgctttaaaatcaacaagaaagcatatgaaaggtgaaagttcttgttgtggcggtggtggagaaatctatcaagctttagaagataaaaaattagacaatccaattattaaagaaaaagtatttaaaattaaaggtatgacttgtcaacattgtgtcgctaatgtaacacgtgcaattaatgctattgaaggcgtaagttcacaagtgaacttaaaaaaagaagaagcacatgttgtctatgatcgagatgttgatgatcaagttattatagctgctgtcaaacaagcaggatatgatgttatttagggaagaagaaattcttctctttttttataaaatgattgatattaatgtctatacatggtacatttgatatgtatagacaagatataattgttgcgattaaaagttaaagaaatacacatctcatacaccaagcactccaaattctttaataatgtctatatataatgaagtatctaaaaagaggatttcaaaaatcctctttttttaccaatatttggtattgctttttgtttgaatattatatttaggtgtatgtggatatttttcaatagatttgttgtttttgatagaccaagcttttgctggaagcgttaaaagctgtggacattttaattcaccatctagtggtttaatgagggaaatgatatcatgataatatttattaccatttgtaagaacataagctctttgatttaagaaatcttcctcattaaattgttcttgattgatactatgttcatagatttctttacgatctaattcatatagaaattcagacattaaatcatgaaaatcaaaaatatattgatctttatgatttactaaaaaattaataattggttcaaaaacttcatctgtattttcgttattccaatctcctttttttaatattccccaaaaagaatttttaaacattttcatcaccatatccattctataggataatgaacaagatatcaaggagtcccttttctaaaccaataaacaatccctgtttcatcaatatttccagagataggattaatagcgatagcatttaatttagatgttaatttataccaactttcttttttgatttctttatttaaaaaatcaattgctaattctttagcaagcactttttcctgactgttttctatttttcgattatcatcatagcctacccaaccattaatgaggatattaggattataagcaacaatcaaattatcataatctgtacttcctgttttacatgctactgtgtattttgtttgataattttccattgttgcatttaaataagttgaaaattgtttattaaaggttcctgttaataattgattgaggattaaacagctttctttgttcaaattttgaattctttgatttttatgttgataaatagtttttccttgatgatcaacgattttttcaatggtataaagatgttgatatttaccaccagaagcaatattacagtagatatttgaaagattataaatgtttgtattaactgttccaagtgctaaagaggcgttgtttttagcgttgattccataggatttgagaaaatctctaagattttctgtacctaaaaataaatgtgtttttacagcataaatattatcgctgacagcaatagcttgagcaagtgtgatttcttgataagcatatttttgatgaaaattagcaggagagtaagttgtattgttacttaatttaaaggtcgttggttcgcatagaaaacgtgtagagggattaaatccgttttctaaggctaaatagtagagaaaaggtttcattgtacttcctatttgtctagaagcgtgtattgcacgattatattgagaattagcgtaatctttaccaccaatcaaggcttgtaattgattggttttaggatttgcgaccgtaaaagcgcattgtagatcaccttgtattttcttttctttaataagatcatttaaagtattttgatattcactgttaaaagaagtataaatatttaatcctttatttaaatattgattattataaaaacctaattcctctaattcttctaaaacagtatccttataataataagtagacatattttcattaagtgaatgttcacttgctaaattaagagtttgcttttgagtggcctctaaaatactttgagtaatcatttgattatcatacatagcttttaaaacaagattttgtctttgtttagctctttctttgtttaaaattggtgaataatattggggaccattgacaacccctgctaacatgcttgcttcatttaaagtcaattcttttgcttttttaccatagaaatactgggaagcattttcaatgccataaattccatgtccaaaatagacattattgatataaccttctaaaatttccttttttgataaatgcgtttctaattgtaaagtaaaaaaagcttcttttactttacgagaccaagtcttttcatttgttaaataaagaagacgagcatattgttgggttattgtgctagcaccttgagaagttttcctttttaggacatttgtttttattgcccgggaaattccgacataatcaaacccatgatgactataaaaacgtttatcttcaatagcaacaattgcttttaaaaaataaggactaacatcatcaattgaaacatattgcccactataattattgacactttgataaaaaatcttattttgatcatcataaagctttatgtaacgatctttattaagttcaggttttcctacacaaaaggcaataatatacatcaataaaagaaatgtgaagaaaaatataaaacaataaagaattctttttatgaactgtctcattttatcaccgattttattcttgccattttatgttataatatgcacggtgatagaatgaaaaagaatattaaagtaaattataagagtatatttaaatatgatgatcatcatgaaacagttcaatttaaaagtgatggaatctatgaaaaaggatttgataaagagaaatttactttctataacaatgatcaaaagatagaaattattttaaaaggtaaagaaatgacattagctaatggaccttctttattaaatctttcttatcatagaaagataggaaatcattatcatacagattatgggatgatagaactctttacagaacttattacaatggaacatgatcgttatttaaaagtgaagtatattttaagtgatgggcatcaacaattaagtgaagtttacgtgatgatgaaatatgatttttatggagaagaaaatgaagcaatctaagaagttattaacgaataaaatattattttcaggtttattgattttaattcaattaattattgtttttgtagcttttttgacaattcatagatcatctagattttttgtctatttgttcaagcttattagtgttcttgctgctttatatattataaataaggatgatgcaagtgcttataagattacctggcttgttttaatagctgctgtaccttttgtaggtggtgttctttatgtatttttaggagataaaaaaccaagtcaaaggttacaacttgcttttttaaaacaaataaagaatcaacgtattattgaaaatgatattatagaagaagtagctgatccttatattaaaggacaaatgaattatttaaatcaacaaagatatcctacttattatggacaagatcttaaatatttttcattaggtgatgatgcttttgaacctttattggaatccttaagaaatgcgaaaaaattcatttttatgcaattttttattgttgatgaaggaaaaatgttgaaaagtgttttagatattcttaaagagaaagttaaagaaggtgtagaagtgagatttatgtatgatgatgtaggatcacttacgatgttgcctcgtcattatgatcgtcaacttgaaaaaatgggcataaagagtgtggcatttaatccttttatacctattttatctttagcgatgaataaccgtgatcataaaaagatcgtggtgattgatggtgaaataggctttagtggtggatttaatttagcagatgaatatattaatcaaagagttaaatatgggcattggaaggattctgggttaatgattcatggtcctgctgttaattcgcttacgaagatgtttttagaatcatggaatgtagcaagaaatacagaagaagattatgaaaagtattatgtgcgctctcatcaaaaatttgaggtagatggctatgtaactccttatggagattctcctttagatgatgaaaatgtaggtgaaaatgtttatttaaacatgatcaatcaagcgtatgattatttatatattacaacaccttatttgatcttagatgataacttacaaacagcattgatcaatgctgctaaaagaggagtcgacgtacgcatcattacaccaggaataccagataaaaaaattgtttttagagttacacgttcatattatcaaacattgatcaaacatggtattcgtatttatgaatatactcctggatttattcacgctaaaaactttttagtggatgataaatgtgcaacagtagggacaatcaatttagattatcgtagtttatatcttcattttgaaaatggaatttatttatataacaataaaatattaaaagatattaaggaagattttttagcgacagtagaaaagtctcatgaaattaccttggatgaagttgtaactggtaaatttatgggttggtttgaagcaattttacgtgtaattgctccattactttaggtaaaaaacattgactttatgcactcttaatggtaacgtataaacgattaaatatcttttttaaggaggtaaaaaatggctgtaaataaaattgaaattgcgttgaaagaagcactaaaaaaagcaatggttaaatgcaattttgtagaagattatgaaataaatcaaatcacaatagaaataccaaaagaaaaaagtcatggtgattattcaacaaatatcgctatgcaacttacaagattacttagaaagaatccaagaatgattgcagaacaattaatcgaagcaattgataaagaggaagcaaatatcgattctattgaaattgctggtccaggatttatcaatatgtttatgaaaaaagatgctttaacttctattattaaagaagtattagcagaaaaagatgattatggaaaaagtgatgcaggaaaaggaattaaatataatgttgaattcgtttctgccaatccaacaggagatttacatttaggacatgctaaaggggcagcagtaggagatagtatttgtcgtattatgtcagctgcaggatatgatgttacaagagaatattatattaatgatgcaggaaatcaaatttataatttagctttatctttatatgcaagatatagagaagcttttggtttagatcttgaattacctgaagatggatatcatggtcaagatattaaagatatcgctgttaaaatcaaagaagaagttggcgataaatatttaaatgcagatcatgatgaaatgattgctttctttagaaaggaaggaactaaatttgaattacaaaaaattaaagatattttagcggaatttagagttcatcatgatgtttggttctctgaaacttctttatatgaagaaaataaagtagttcctacaattgaaaaattaaaggaaaagggatttacttatgaacaagatggagctttatggtttaaatctactgaatttggtgatgataaagaccgtgttttaattaaatctgatggaagttatacgtatttaactcctgatattgcttatcatttaaacaaattagatagaggttatgaatatttagtagatttattaggtgcagatcatcatggttatatcaatcgtatgaaagctgctattcaagctttaggttataatagtgatcaattaaatattgatattctacaaatggttagaatgatggaaaatggtgaagttgttaaaatgtctaaacgtacaggaaatgccattacaatcaaagatttaattgatgatattggtgtggacgctacacgttacttctttgctgctaaagctgctaatacaccttatgattttgatttaacattagctaaatctaaatcaaatgataatccagtttattatgcacaatatgcgcatgctagaatgtgttctattttaagacaagcaaaagaaaatgaaattacagttgcagatcattttgaattattaattaatgataaagaaatggctttattaaaacatattaatgaattcagaaatgaaattgcggatagtgcaaaatctagaagcccacataaaattgcaaattatattcaaagacttgcacaattattccatagtttctataatgattgttatgtaatagataaagaaaatgttgaattatctaaacaacgtttagctttagttgaagctacacgtattactttaaaaaatgcattaaatttaattggtgttgaagcacctgaaaaaatgtaaggagagataaagatggataaaaatagatcaatggttgatgttgcttatgaattaatgtctaaaaagaaaaaagcagttaacttctataaattatggcaagaagtaagtgaagtaaaagggtttgaagaagatgaaaaagatgaaaaagaatctttattctatacaaacatcactttagacggacgttttattacagttggtgaaaataactgggatttacgttctcgtcataaatttgatgaagtacacattgacatgaatgatatctatactgatgaagatgaagaatctgaagaagtagaagacgatgtagatagtacaatcgaagatgattataataactaagaggcaaggcctcttttttaataaaatccttgctttcaaataaaagtagatgttcttattaatgaaaggattattttatgaataaacgacaaacaaagattttagaattactcacacaaaataaaaaaatagaagttacaaaactttctgaattactaggagtttcacaagttacaattcgtaaagatttagatgctctttcagaaaatggtatgttaattagagaacatggatatgctactcttaataaaagtgatgatatgaatattcgtcttgcttatcattaccaacaaaaacaacaagtagctaaaaaagcagtagaatcgattcaacatggtgaaacaattatgattgaatcaggttcatgttgtgctctagtagctttagaaattgcaaagacaaaaaaagatgtcacactgattaccaattctgcatttattgcagattatattcgtaaacatacagctattaaaattattttattaggtggagaataccaacatgaatcacaagttatggtaggaccaatgatgagaaagtgtgcagaagcattttttgtggataaactctttattggaacagatggttttagtattgatacaggatttacaggaaatgattatatgcgttgtgaagctgttaaagatatggcaagacaagcaagtcatgttattattgttactgaatcagataagtttcatcaaaaaggagtttctaatttaattgatttacatcaagtatcatgtatttatacagatcaaggaattcctcaagaagttgaagaatattttaaagaaaaacatatacaagttgaaaaagtttgatcctaaggtttccttaggatttttgtagcaaaaatgtaaaggaaagttgctggtgataagaagtaagaatgttataatttttctaggaggtgacaataatgcttaatgaaaagatagtgtattatagaaagaaaaacatgcttacgcaagaagaactagcatatcaattaaatgtttcaagacaaacagttacaaaatgggaaacaggaactatttatcctaatattgagtatttaataaaactttcaaatctttttggtgtttcaatagattatttagttaaagaagatgattgtttaacattagaaactcataaaattgaaataagtgaacttgcatgctttcttgtgaaagccaaaaaggcaacgtatgcaaataaaactaataaagtcaattcttcaagaaaagagtctcatgattattcatatcaagagaataattatacttatttagattctttctttggtgcggaaaattttagtggacaagaaattgtttataaagatgaaaaaccatgttggtctatgaattactatggaagggttatagaggaaaactttaatggtgattttttaaaagaagctttattacaagttgatgaagaattgccttttagaggtcctttattttatcaaaaaggggagtatctttacttgttgcgtattcaaggaaaaattgatttttttcagggtgttgaagaaatatattatcaaacatataaagtttatgaaggatttatacaaggcggaattgtgaaataaataatgacaaatattttaaataaattttaatatactcttaatgaagaatggttatttctaaaataggagagagtatatgaaaaatttagaaagaaaagatattttaaatgtgaaaaagcatactaaaaataaaagtgtttttaataattcacagcttgtattaaatattttatatgatacaagtattaagtataaaaataataaaagctatcctcgttgatagctttttaaatacttaaaagaaacaatcaatacctttatctaaaaagatttgttggtaatctttcaagtcttcttcgtgatatgcttgataggtttttaaagtatattctttatttaataagtcatatttcttttcaccaaattgatgaaaaggaagaagttgtactttttgaatatttgatgcttttaataattcacttatcccttcagcatcttctaaagaatcattaaaatcaggaataacaggaatgcgtggtaaaacattaagttgatgttgaatagcccattgaagattttcaacaattaaatcattataaacacctgttccttcaaaatgttgaagtcgatcataatgttttacatcaaagagtaaaagatcaaataaaggggctagtttttgaaatgtttcttgttgaatatatcccgttgtttcaatggcgacatggagatttttttctttaagagataaaacaagcttttctagaaattcaggttgtgccataccttcccccccagagatagttacaccaccattagattcttcataaaaatcaatatcttgcatgcagacatccacaatttcttgaatttctttaaagtctccttcatgacttaatgctttagttggacaatgattgacacattgtagacagccaatacatttatcatgattaaagatcatatggttttctttttcggtaattgcttgttttgggcagttaagtaaacatttcttacaatgagcacatttttcaaaatcgtaaagtatttgtagtttatgtaattgggattcaggatttgaacaccatttacattttaaaggacagcctttaaagaaaacagtcgtacgaatacctggaccatcatgaatactaaatttttgtatattaaatattaatcctttttccatagtttttctcctcgctaatatcctaacatatctttttataagtttcaaatgaaaccaaaattgtttatttatgaaaataatattgacttattttttgcttattatataatttaattgcaaaagaaagaataaaaacttacgaatgaaagttgaggaaagaaaaatgaagaacagtgaacactttggtgaacttacatcaagaatgaatcattttagagaagaagttttagataaaaaaccatatatctgtgcaaaaagagcactccttgcgacagaggcatataaagaacatttaaatgaaccgccaattatgaaaagagcgtatatgttaaaaaacatcttagaaaagatgcctatttatattgaagaagatactttgattgtaggaaatcaagcttcatcaaatagagatgcacccatctttccagaatatacaatggaatttgtgatgaatgaacttgatctatttgaaaaaagagatggagatattttctatattactgaagaaacaaaagatgaattaagatctattgcaccattttgggaaaataataatttaagaagtaaaggaggcgctttgcttccagatgaagtgagtgtttatatggaaacaggtttctttggaatggaagggaaacttaattctggagatgcgcatttagcggtagattatcaacaagttttacaaaaaggtttaaaaggatatgaagaaagagttaaagatttaaaagaaaaacttgatttatgtatgcctgaaaatattgataaatatcaattttataaagctgttttaattgtcattgatgcagttaaaacatttgcaagacgttacagtaatcttgctttagaacttgcagaaagtgctgatgggaaacgaaaagaagaattagaagaaattgcacgtatttgtaagaaagttccttatgaaaaagcagaaactttctatgaagcgattcaatcaacatggtttattcaattaattctacaaattgaatcgaatgggcattctttatcttatggacgttttgatcaatatatctatccttactataaacatgataaagatcttcataatataacagaagaacaagctattgaattattagataacttatggatcaaaactctaacaatcaataaggtgcgttcacaagcccatactttttcaagtgccggaagcccaatgtatcaaaatgtaaccatcggtggacaaacacctgataaaaaagatgcaacgaatgaactttcatatttagtattaaaatcagttgcccaaacacgtttaccacaaccaaacttaacagtgcgatatcataaaaatatgccaaaagcttttttggatgaagctattgaagttatgaaacttggtacaggaatgcctgcatttaataatgacgaaatcattattccatcatttattgaaaagggtgtcaaagaagaagatgcatataactattcagcgattggttgtgttgaaacagcagttcctggtaaatggggttatcgttgtacagggatgtcttatatgaacttcccacgtattttattaatggcaatgaatgatggggtagatatgacttctggaaaacgattctttgaaggtagtggttactttaaagatatgacatcttatgatgaactctttaaagcgattgaaaaaggaatgcgtcatttgacacgtatgtcagtgattgttgaaaatgcgattgatttagcacttgaaagagatgttcctgatgttttatgttcagccttgacagaagattgtattggtcgtggaaaaacaatcaaagaaggtggcgctgtttatgattttatttcagggttacaagtaggaattgcgaatatggcagatagtcttgcagctattaaaaaacttgtctttgaagaaagaaaaatcacacctgaagaattatggaatgcgattttagatgattatacaagtgaagaaagtcaaagaattcaagaaatgttagttaatgatgcacctaagtatggtaatgatattgatgaagtcgatcaattagtagttgatgtttataatatttatattgatgaaatgaaaaaatatccaaatactcgttatggaagaggtccaatcggtgggattcgttatgctggtacttcaagtatttctgccaacgttggacaaggttatggcacaatggctactccagatggaagaaaagcacatacacctcttgctgagggatgttcaccagctcatgcgatggataaaaaaggaccaactgctgtgtttaaatctgtttctaaattaccaacacatgaaattactggtggtgttttattaaatcaaaaggtaacacctcagttattatcgaaagaagaaaataaagaaaagattgaaatgttgattaaaaccttcttcaatcgattaaaaggttatcatgttcaatacaatgttgtttctaaagaaacattattagatgcccaagcacatcctgaaaagcataaagatttaattgttcgtgttgctggctattccgcattctttaatgtgttatcaaaagcaacacaagatgatattattggaagaactgaacaaacattataggagaaaagaaaatggaatttataattgatacagtaaacttagaagatataagtgaagctgttaatattttttggaactacatagatcgttattggacagataattcactttctacagtagaggtatttacaaagacctttaattcaacagcaaatacgattatggaaaaatcaacaacttctaatgatattattaaaatcatttgtattattgttggcattgtcattgtaattggtggaattatttatatcttgcgtatgaaatttaaacgagataaagaaaaagctaaagaaacagttgaaatattaaaaacacctcttgataaatcagatgaattaagagacaaatacttaaatgaagaagggaaagaataactatgggaattttaacaagatttacagacattatgaaaagtaatattaatgctttattagacaaatgcgaagatccagcaaaaatgattgatcaaacattaagagatttaagagaagatcttgctgaagtcaaaaaagaaacagcaaacattattgccgatgcaaaaagtgctgatcgacaagttaaagaatgtgaagaagaaatcactaaatatacaactgctgcacaaaatgcattaaaagcaggtaatgaaaatgatgcaagaacattgattgctaaaaaacaacaatatgaaagcaatcttgtttcatacaaaaaaacacaagaacttactcatgccaatgctgataaaatgcgtcaaatgcatgataaattagtaaacgatatcgaaacattagaagctagaagagatgctattaaagcaacagttgcttctgctaaagctcaagaacatattaataaaattgtttctggtggagataaagcaaaatcttctatggaatcatttgaacgctatgaaaagaaagcagaaaaaatgcttgatgcagctactgcagaagctgaattaaatgcacatacaagtgctgcttctactcttgctgataagtatacatcaaacggtagtgacgcttctgttgaagatgaattagctgctatgaaagcaaaacttggattataatataaaaactgtaaagatactcatattttatttatgagtattctttacagttttttatttatataagattctttataaaataatatacatgtattattttttcttgctaattctgctttcattttaaagaagcaatcctttgtgcataatcatcactattaaatatataacttccagcaactaatacatcaacacctgcatctttacatttttttcctgttgtttcgttgattccaccatctacttcaattaagtagcgatcattattttcttttcttctagtatctaaatctttaattttggctaaagcaatttctttaaaggattgcccaccaaatccaggttcaacagacatgactaaaacgacatctaataaagataaataatcttggattgtatcaactggtgtatttggtttaatacttattcctactcggacaccattttctttaatatgatgaataagtactaaagtgtcttctttattgtccattgcttcaatgtggaaaacaataaggtttgctccacttttaataaattcattgacatacttttgaggttcactgatcattaaatgaacatctaaaaataaatttgtcactttagaaacatcttctaaaatactatatccaaaagaaatattcggaacaaaatgtccgtccataacatcataatgaagccaatcagcttttccattttcaattttttctatatcatctttcaagcatgtaaaatttgctgaaagaagagaaggtgcaactttaaccatattatttctcctttttctcaatctctacatcgttactcttttaatgaatttataaaatcagctctattcgctatttttttaatttcatttataatattcttattcgatacaagatcatatatttccaaaacaatttgattaaattcagactccatattattaggaacagctaacatcactatcatatcaacataattatttccccatttaataggatttgttagggtcattataataatacttgtattaataacagttgccgggtccccatgcggtaatgcaacactattttctaaaactgtatcacctagttcttctcttttatatacagattctctaaatccacttttaactgctttattttgttgtaatatatcaatcataaaatccatacattctttttttgaatttaatgcagatttaaaaaatagatattttggtttaatatattttttcaaagtagatagttttattttattactttttattgtttcattaagccttggagttttaataaaaacattttttgcatatacatcaaaaatatttgcataatctatattatctaaaaatggacttacttttacaactggtatttgtgaattaaaatattcactagttgtactaattataagatctacattattcatattaatctgtttcaaattacttaaactgcaggattgaatatcatcatatttaggaaggacagatcgtaatctattaacgatatattttgatgatgctattccatatggacaaataactagaattttatgagatactgtagatttattaatagcaatttgaaaatatatagtaataaaagaaacttcatcatctgttaaaatacagtcaaatgtactttcaataattgataaaacataccatgaaactgtaaataaaggtagatatcttgtttttatctcacataaaataggattaacaatattaacaccattttttaatctcataatcattgcaggaatatgttgatataattgtttttctaattcatctctattagatattactatattttctgttttttctaatcgattaattatttcatttataagcagatgatatttgcttttatcaacatctatctttgtcattctatacgatgctaaatacttagtaagaattattttatcttcacctgttaaatgaatatccaccttttcttctaagtattcaataattctttgtacaaatggataatctgaaataaacaacattccgtctgtattaatatattcttcgtcacctatatgataaccatgtttatttctatagataaatacaagtaaagtaacattgaaagcatttttataataatcagttatttgaatattattaaatgaaattatatcattaaacacctctaagattaaatcatacaaatcatttccaaaaaaatctacaaatggaactttatggaacgtaattgtatttaataaataatctattgctgcagattgaatattaaattctgaacctacagcaataatttttttatctgttgttttaaatgaaacatgaaattgttttaaataactttttgtaagataatctaaatcatttaaaatagccgttttactaacatagtattcttcagcaatattttgaagtgaaacaccttttccttttacaataatattaataaatagatttcttctacgaacatctatgtcaaatttattgtctgtttcaatttcttttaaagtattagctttttctaatgctttattgatatcttgttttttaccaataacttttattccacgataaggccttttatctatttctaaattataggatttcaactcatctcgtaatacattaatatcaatataaattgttttaggagtaacatcaaacttatctgccaatatttgagcaggaacataatcatcctgtactaacaaataatttaatatttttagttgtctcgttttcatatttgcctcctctatgttaatataattaatattttactttctaactatttaccaacatttttattcaatcgatcaccaacttctccactaggatgattgactaaaaatacctcttgtgaaaatgaagtgtttttttcaagataaatagcaatagcatcaaacaacgaaataaccgctaatgtactcgctgttgctaacatattataagcatctggttctttttcaattttaacctttaaaaataaatctgcaactttacaaatacttgaactttcattttccccaacataaaccaaataagcacctttacttttaatatttcctacaaatgacacaagctcattcgtattaccaccttttgaaataacaatgaaaatatcatttttatctacaacacctaatcctccatgtactgcatccgaaggattcacataaaatgctttttgatttatcacttgaaatgtatgtacaattttttttgcagccattgctgatgtaccacaaccagaaacaaatatatttccttcattatcctttattttttcaattaatgtttcaacacttctataatctaaataatgagaaagtttttttaattcttcactttcagcatcaataacaaactgaatatctttttctaacattgtttattcccccattaccataatattgcacattctatttctttctcttgtctgatcaaaatccacaaaataaattgaacctacttcaccaattaaaagtttaccatctctaacaataaaactttcacttgctcctagcaaatcagagcgcaaatgaccatctgtattcaacattgtccactctaaagcgggataattaggatctgtttttgccattccatatttaatatgttctggtccagggctatgatattgtccttcagttgtttgtgtcggtataatcttttctaatacttcatttaaatctacttgtaataaatcatccccatagtaatttacatcatgcatatattcatcaaaatatactgaacaagttgtatgaggtgaagaaacaataacaacaccgttatttatttgacttttttcaaatatttttttaacatcacttgttatattatgatatgacggtctatttgaaactgtttttaatttaagttgttcatgcaaaaatttcattttaaaattttctcctttaaagatacatacaccgcttcagcaccaaatccagttaataattgtacgcccataattactttatccttaatatcatctggaacttgtgttgttgatagtacaatatcatattctccattttttatagattctaattcttgtccaacagctgattgtttaatttccacttgattttctaatccttcttcttttaaccatctgttaacttttgttcttacaactgttgaagtagcatgacccgctccacacataataagtaattttttcataatatttatcctctcacgcaattattttatgcattaaatttttttatcttatttacatagaataataatcctaaaataacaactgtaataattaaaattcctggaagtgaaaatacttgtccaataaataccattaatgcatttggccataatcctgctgaaacataagataccagtccacttgatccaacactatattgtgctaattgataagctttagttaatgcaggagctaaccatgttgctaaataaagcattgatgcagaataaattccacatccaataactgatcttaaaatatttcctttaaatgctgctaccatacaagataatgcaaatactaatgttggtaaatcgccaaaaggtaagattttatttcctggtaataccactgaaataaagagtgttactggaattaataatagtgctgttgccataactgctgagtttccaactgttaatgctgcatccattccaatattaacaactttaccatgtaaatattttttacaaaattcttgagtcccttcagcaattggagttaaaccttccataaacattccaaccatttttggaagaatttttaataccgctgccatttgaacccctaatgtcatgaatccaccaaaatcataaccagctaataaaccaattactacaccaattacaaacccaataataataggatcaccaattaatccaaatttttcttgaattgtttctggatcaacatctaaatcttttaatccaggaattctatcaaaaagccaatttagaggtactgctaaaaccataccagacaatgccattaaatgcgtaatcgcaattcctgggaaattaaagaatttacttaataacggttgtgataaatccgcaagtagcaactgtaataaaaaccctggaatcattgcaattgcaccatatacataattacctgtaatgccccaaaccataacaccaattaatgctggttgccataaattccaaacatctacatttaatgtttttgtaattcctgtccaaactaaaattaaatttaaaataaatgctacaggaataatcaatactcctaatgttgtagaaaagcttaatggtcctgctgttccactacccaaatccataatacttaatgtcaaaccataattttttaccataagtttaattgcaggtcctaatacctcttgtaaaaaacctgtaaccatatttaaacctataaaaccaattcctactgtaatacctgctataatagcttttgaaggtttaactcttacgattaatcctaaaatgataataataataggaataaacacaactgagcctaaaccaataaaccaagttactgcatccgcaatcatatttatttctccttaactatttaatattttttctttgtaatatatttttaaatgtttcaatattatcacattcatctaattctttcataagcacttgatcactaaacatttccattaattttgtcaatgtttctgcttgttcatgaggggcagacatagcaatcataaacaccaatgtgactggaattttctcatcattatttgccatatttttaaaatacaccggctcttttaatgagacaaattctatttgtgatctatttacataatctgaatctgtatgagggatagctacacaatattttcccgtattcaatcctgtaggaaattcattttctctttttaatacattttctagaaaattctttttcactactcctctttgatataactcatttgcagctatttcaatcacttcttcagccgaactagctaaaatgtgaaattgtgcaatcttttcattaaaaaacatgtatactcctctctttttatctgctaaactgcgtccagtttaagtctcccgtcaaaatctatgtacattatttttttgacacttaaatcttatcatcactttaaattgtaagcaattacacactaggttcataatattctacacattaagaaaatttccatattaaatgttaacctttttttatttttatttaagattaagtacaaaaataaattttattacatcataattttgtattataatattttcgaggtgaaaccatgaataaaaataattatcatacccataccacgagatgctatcacgctagtggaaaagatgaagaatatgtaaaagcagctattaaagctggcatcaaagaattaggattttctgatcatacaccttggcattatgattcttcttttaaagcaacaatgcgtatgcctgcaagtcaattagatgattatattgaaagcattcgttatcttaaagaaaaatataaagatcaaatttctattttaattggattagaatgtgaatattttgaaagatatatgccttggcttgaaaagatgttaaaagataaacaaattgattacattattttaggaaatcattactatgaaacagatgaacttcatcaatactttggaagtcctgtcaatgaatactatttaaaagcttatgtagatcattgtattcaagcaatcgatacaggtctttatagttatatagctcatcctgatcttgtttactatgataaagattcaaaactttatcaagaagaaatgtcacgtttatgcgcttatgctaaagaaaaagatatgcctttagaatttaatctattaggatttatgacacatagacattatccaaataatgctttttggaaaattgcaagtcactataaaaataaagcaatcattggctttgatgcacatagtcctgatgctttattaaaagatgatatttatcaacaagctttcaattatctatcttctttagatgttgaactaattgatacaattcagacattaaaaaaataaggattttttccttattttttattttacaagttcaatcgcttgtttacctgttaaatgttcaattgtaatttctacacaacaaagatttttccattctctttgaatttctttttcaactgcaatttcatcatcacaatattttaatcctaaagcatttaccgcttgatagatttcatcatcatcttgtaagatttttgcttttccaaaaagaataatacttctaaaataagttgttaattcttcttcaataacatcttcttgatcaataatacttattgatactttagaattatttttaatagcgtctattttatgtcctgattttgctccatgaaaataaatctttccatctaagtaaacataattaacaggaactgaatatggatacccatcatcaccatgtaaagcaagtgttgctgtttttgctctttttaaaatatcaatacattgcttttcagttagtttttgtttttttcttctcatttctctaaacatattattacctatatttccaatgtaaaaaatttatgtaagatatcttttgtcacttctctattttctttattcactaagattgttaaatgatcacctaaatgtagaattgtatctcctcgtggtacaatttcttcaattcctcgattaatagaaataataatacattctttaggtaatcctaattctttgattggtaaatctaaacaacatgaaccaagttctacagaataatggagaatttctttttcttctaaggaaatttcatgattgccatttttaatcattcgattaagtaaactatgataaataggttcacatttcatcatattagctacaacataaccaacaaaactacatacagcaattggtaaaaactgtgataaacttccacacatttctgcaattaaaacaatgcctgtaataggagcacgaacaatactcgcaaataatcccgccattgctacaactataaagttattaaaatacatttgtggaacaccacaataagttgtcacaattaaagcatacgcacaacctattaagcttcctaaaacaagcaaaggaaagaagatacctcctggtgtgcctgagccaaaggaaataagtgaaaagataaatttcattaataaaagtaataaaatggtacttaagacaaagtttccttcatgaagaatatctataatatgatgtccaccacataaaacatctggataaaagatcataaaaacaacagaaatcaataaaggaatatagattttttgattgtttttcaagaatgtaattttatcatagagttttaaagtaaacatagttgttttattataaataacacctaatacaccaacaataatccctaaaataataagaaaaccatattgtcctaaaggcaaagtatctgcaagtggaaaataaagtgaaggggtcatcccaaaaatatttttacttataaaatcacctgttaaagatgctaccataacagtaacaagtgccagtggtgaaaagtttttatggatttcttccaaagcaaataacaccccagcaagtggtgcattaaaggctgctgaaagtcctgctgctgccccacacgttaaaagatatttttcctcaagtttcattcttttaaatgcagaagctagtcctttaccaaccattgctccaagttgaatacttggtccttctctacctaatgataacccccctacaatagaaagtgtccctgctaccattttagcaagaataactttataccatttttcatcaatttgatcaatcatttctgcttctacttgtggaattccacttcctgaaatataagattcatattttaaaagcttagaaataataaaaccaataattaaaacacatacaatccaaatacataaatgaagtgtgttatttttgatataatccactacaaaataagccatcttttctccataagaaagcaacaatctataaacaacacccacaatacccgctaaaataccaacaataaatccttctaataaaacaatattatcaaaacgacttttagagcttaaaaaacgagcaattgaaaactcttttctttccataattctcccccaattcgttttttattatagcactttattaaaaagaaaaacacaagaatcattactcttgcgtttcatctttttcatcataataatttcttactaatgattgtgtttttctaatatgtttttcaacatttgcttttgctagtgctttatctttctttacaatcgcttcataaatttctttatgttcttgtgctgcttcaattaaacgatttggttgtttaattgaatgtctggaagtaacatgaatataatagttaatatctgacaataattgttcaaaatattgtgaatgagttgctctataaatagcttcatggaaatcaatattcacttctgtaaatctttcttgatcatttttttcagcatagaattctaataaatcatagatttctttaattctatctaattcttcttgagtaatacgctcaatagcaagttgtacagataaactttctaaaacaacacgaatttctaacatatcatcaatatctcttgatgaaaaacctaatacataaactcctttattaggaatacttttaactaatccttctaactctaattgttttaaagcttctctaataggtgttctagaaatatttagttctttagaaagaacaacttcatttaatttttgtcctttttcatattcttcatttaaaatcttatctcttaaaatacaaaagatgcgatgtcctaaggaaccatgtcctgcattttctaaaatattttttttcatactataacctatctataattgcttgcgtgaattcctttgtagaagcatgtccaccaatatcacgcgttacaatttttccctcttctacgacttttgaaagtgcatcacgtagcctatttgcttgatcattttgtcctaaggcttctaacattaaagcaaacgctaaaagcaatgcacttggattggcaattccttttcctgcaatatcaggagcactaccatgaacagcttcataaatacggtattcatctccaatatttccactaggagcaaatcctaatccacctactaaacctgcacataaatcagaaacaatatctccatataaattaggagcaaccaatacatcaaatgtttctggtcttaaaacaagctgcatacacatattatcaatgattacttcttgtttttcgatttctggataatctttacctacatttctaaaacattctaagaataatccatctgtaaatttcataatattcgctttatgaatggctgtgactttttttctaccatttgcttttgcatattcaaaagcataacgacaaatcttttcactggcttctctagtaattaatttaataccatgcgcaacatcatcacccaccatatattcaattcctttataaagatcttccgtattttcacgaatcatgactaaatcaatattttcatatttagaatcaattcctttaaaagaacgaattggtcttgcattggcataagttgcaaatttttgtcttaaagcaacattgacacttctaaatcctgtaccaataggtgttgctgttggaccttttaatgcccatttatattctttaatagcatctacaagtcctggttcaaagacttcttttgttttagcagcatattctgcaccagcttgatattctacccattcaatatctaaattcatagcttttgtaatgtcaacaacactttgtgaaatttcttttccgattccatcacctggaattaatactgctttcattaaaagtcacctcctaattctttaattgcatttaatagaccaccatattgaatcattgttttttctcttggtgataattttaattttgcggtaattgtttgattatttgttttattgataacagtaatatctttattgttttcaacactatctaataaattaattaattcatattcatcttgatcattaaagaaatcgtaatctttttgattaataacaagtggtaaaataccattattaattaagttcgaacgatgaattcttgcaaatgaaatagcaaaaattgctttgatctttaaataattaggaacaagggctgcatgttcacgtgaagaaccttgaccatagttatctccaccaacaataaatcctccaccattttcaatgcatctattatagaattgatcatctactttacagaaagagaatttagcaagatgtggcacattacttctatatgggagtaatttagaatcagatggcacaatgtggtctgtagaaatattatctcctacttttaaacatactttacctttaaatgtatctggtaatttatctcctcgaggaactggtttaatatttggtcccatataaacttcattttgaggatcatattcatcaataaagaaattcttattcttcacaaatggtgtattttcaatatcgtctaaatacatatcatcttcaaattcatctgttaaatatcctttaatcgcacttaaagctgcaacttcaggagatactaaataaacactagcgtcatttgttcctgaacgtcctttaaaattacgattaattgttcttaaagaaacacctttagatagtggtgcttgtcccataccaatacatggtccacaaccacattctagaattctagcaccagaggcaatcatatctgctaaagcaccacatttagaaagcattgcaagaatacttgaagaacctggagcaataacaagtgatacatgagttgctactcttcttccttttaagatttttgcagcttttaacatatcaggaagtgatgagtttgtacaagaaccaatcactacttgattaattttcattccttttaattcacttactggtacaacagcatctggactatgtggtttagcagttaatggtactaattttgataaatcaacggtgatttcttcatcatatgtagcatcttcatccgcttttaattcaacataatcttcttctcttccttgttgaattaagtattctttagtaatttcatctgttggaaagacagaagtcgttgcccctaattcagcccccatattacaaatagttgcacgatctgttaatgataattcttttaaaccttctccagtgtattcaataatcttattaactccacctttgacagataattgttgtaaaatatataaaataacatctttagccgaagcccattttgcttttttacctactaaattcactctaacaacacttggacattgtaaataatatgtacctgttgccattgctacagcgacatctaatcctcctgccccaatagcaatcattcccatcgcaccacatgttggtgtatgtgaatctgatcctactaatgttttaccaggttttgcaaagttttctaattgcaattgatggcaaacaccatttcctggtttagaaaaagtaattccgtgtttttttgctacactacgaataaactcatgatcatccatattttcaaaacctgtttgtaacatattatgatcaatatatgcaactgccttttcaaccgctacatgttcaattcccattgcctctaattgtaaataagccattgtccctgttgaatcttgagttaatgtttgatcaatttgaatccctatttgttgaccagcgactaactcaccacttttaagtttagtacttaagattttatacgctaaattcattattctacgtcccccttattacgattgtatacaattatacattccatgtgtattattgtaaatacattctaagtaaataaagggatttttttacgtatattccattaaaattgtatattgtatacagttatcaatcatttaaaaagggagcaaaagctccaactttttataaatctaaggcataagcaatcgcaagttttgttgtatctacgattgaatcaatatgacaacgttctttaccatgtgaattgatcacagccataccaaatgctgcagcataaacattattacctgcacgaattgcagcattagcgtctgttccataatggaagaaaacatcaacacaataatgtaagtttgtttttttagcttggttgataattcttgcagtaagttctctgtcatatggagaatagttatctttagcacagatacttactgttttttcatcagcatgataatcaggcccaattaatccaatatctaaagcaacatattcttctacttcttctggtacataagctccaccatgtccgatttcttcataaattgggaaagctaataatgtacgatattttggttttaagttatttcttttgaagtaagccatcatttcgattaatgcagcaactgcagctttatcatcaatataacgtgaaacaacatatcctgatggtgtatattcgaaatgaggatctacagagatcacatcaccatgatcaatacctaaagccataacttcttctttagaatgaacatcttcatgtaagataacttccatatgatcttcatctcttggcattgttctagcatcttcaaatacatgaactgagtgagctttacaaataaccatacctctatatttgcgtccatctcttgtaataagagtaacaccttcaccttccatactatggtagttaacaccacctaattgtcttacaattaaatgaccgttatcatcaatatgacgaacaactaaaccaattgtatctaagtgagcacccaaacatactgttttagaattatcttctccttctaaagtaatgtaagctgttcttttacgatcataagtcacttcataaccaaattcagctgcttttttttctaataaagcaccaacttcttcataatagcttactggacttggtacattaataaattcttcacataattcaactaattcttttttgtcaatattcatttccattttataatacctcttttactttttatcatataaatgacatgcgcagaaatgacctggttctacttctttaaaatcgggtctctctgttttacaaatatccattactttcggacatcttgtacagaaacgacatccttttggtgggttggctggacttggcacatcgccacctaatatttgtttatcttcgattctttcttttccaattcttggaattgctgaaaataatgcttgagtataaggatgtaatggtttggcataaagtgattctgtatcagccatttccatcatattacctaaatacataacccctactctatcagcaatatgttttacaacacttaagtcatgggaaatgaagatataagcaatacccattttttcttgtaattcatttaataagttaatgatttttgcttgaattgaaacatctaatgctgaaacaggttcatcacaaataatcaattttggttgtaaagcaattgcacgggcaatcccaatacgttgtctttgtcctcctgaaaattcatgaggataacgatacatgtagtctaaatttaaaccaacttgtttcataacttccacaacacgtgcatcacgttcttcttttgttttataacatttagcgatatcaattggttcagcaataatatctttaactgtcatacgtggatttaaagaagcataaggatcttggaaaatcaatttgattttatcacgtgcttcttgtaattctttaccttttaagcttgtaaaatcttgaccatctaagatcacttttccttcagttggttcaattaaacggattacacttttacccattgttgatttaccacatcctgattcaccaacaatcccaaatgtttctcctattttaacatcaaagctaatatcatctaccgctttaacaacgctttttttacctcttaaagaagatgatttaatagaataatatttctttaaatgttctacttttaataaaacgtcttgattattttccattttctacatcctccttattccatctttcatgatatttccaacaacgaactaaatggttttcaccatgttccatcattgctggacattcttgatgacagatttctttggcatgtttacaacgtggtgcgaagaaacatccttttggaagttcataaagcattggtacagaaccaggaataacttccaattcttcttgatcatcgctatcgatatcagggattgatcttcttagaccaatagtataagggtgtaaaggatttttaaataaatcttctacatttgtatattctacgatcttacctgcatacataacgattacgttatctgccatttctgaaataacacccatatcatgtgtaattaataatacggctgtatttaactcttttttcattttattaattaattttaagatttgtgcttgaattgtaacgtctaatgctgttgtaggttcatcacaaatcaataatgatggattacatgaaagtgccatcgcaatcatgattctttgtctcatcccaccagacaattgatggggacaagaagcaaatactttttcaggcattggaatacctacaagtttaatcatttctaaagcacgttctttagcttcttgtttactcattttttcatgagttaaaacagcttccataatttgttttccaacagtaataactggatttaaagatgtcattggctcttggaaaatcattgagatttctttaccacgaatatctctcatttctttaggagatttctttaataaatcttcccctttatacataatttcaccagcagtaattttacctggaggagatggtattaattgcattaatgataaagctgtcatacttttaccacaaccagattctccaacaactcctaaagtttctcctggtttgatattaaaacttacttcttgtacagcaggaagcgctccacgatctgtaaagaaggtaataccaagatctttgacttctaataattctttattttcactcatatcttttcccctttttacgatcttaattttggatcaagcgcatctcttaatccatcacctaacatattgaacgctaatactgtaataataatagctaaccctggaattactgaatagtatgttgcactacgaatatatggttgtgaaaaactaatcattgaaccccagcttgccattggtgctttaacacctaaacctaaaaagcttaatgatgcttctgacataattgcatttggaatacctaatgttacagtaacgattaatgttgataaacagttaggtaataaatgtttcataataattctaaaactatttccaccgctgactttacatgcatcgatgtattccatctttttaagacgcataacatccccacggataagtctggctgttgaagcccaacctaaaaggccaagcgctaagtaaaggttaattaaacctggtcctaaaacgaacatgatagccatcgcaaataataagaatggaaaagatgaaaatacttgaattaaaaatgaaataacagaatctacttttccaccaaaatatccggcacaaacacccatcgtatacccaataactgtcgcaataatttgtgaaatgataccaacacttaaagaaacacggcatccataaataattcttgagaaaatatctcttcctaaatcatctgtaccaaaccaatgttgtccgcaaggtttcattaaacgatctgtaagaacttgtttgtttggatcataaggagcaatcaatggtgcaaataaagcaattaagcataaaagaataacgatgaacaaacataccattgctactttatttttcttgaaaatgttccaactgattgaccaataactttgatatgtttgatcttttttctttttaaacattttatgatgactcctttcctaaacgaattcttgggtcgactactgtataaagtaaatcaactactaaatacataatgacacaaataaccgcaatatacatcacgccaccttggacgattggtaaatcacgtgtattaatactatctactaacatttttccaattcccggaattgaaaatacagattctactaagacagatcctgttaagatgtttcctaaatcagatcctgcaattgtaataattggaattaacgcattacgtaaagcatgtttaattgtaacaacccaaccttttaaacctttagcttcagctgtacggatgtaatcttgtgataaaacatctaacatacttgttcttgtaatacgagcaatacttgctgcatatcttgtacctaaggcaatacctggtaagataaatgatttaaaactatcaatacctgataaaggtaataaattaaatttcaaacagataacaatttgtaagatgatagcaatccagaatgcgggagctgaaataccaaatacagaaattgtcattaaagctgaatcaacccacttaccatgattaacggcagccacaacacctacgactatccctaaaacaacagctaatatataagcaataccagcaagcttagccgttactaaaaatgaacttgttaaaatatcaattactggtttattttggaaatatgatgttccaaagtttccttgaagcatatttcctaaccagctgaaatattgaatataaattggttggtctaatcccatttcatgtgtaacacgtgcaatcgttgcttgatcagcgaactcacctaacatgatttcaactggattaccaggcacaatgtttaacacaaagaatgtgattaacgaaatacaaaaaacgacaccaatagcttgtaatacacgttttagtaaatacttcgtcatatttttcctcctttttcctacaataaatatatggaatgcattgctgcattccatatatgattaacacttatttaatttcatttactattttttagataaatcaatatcaatgttatataaatgataaattaagtttcctaatttagcattttttacatatggtttagcaacaaattgtaacttaccataatataatggaattgttccataatcatcacgagataagatataatctgcttttttgtataattcaacacgtttatcagaatcatttgattctcgagcttctttcattaatgaatcgaattcaggattattgtagaatacaccttttcctacagcgttttctgaatagtaataagtatacatttggttatcagcatctgcatataatgggaaccaaccaagaactgtagcttgtaattcaccagcagctctagctgaagaccaaatacctgcatcaattgtttctacattcatagtaattccagcttcttttaagtaagcttgtaatgcagtagcgattttttcttctttttgtctaactttgcaagtaaatgtagggtttgaaatacctgcatcagctaaaacttgtttagcttttttaacgttatgttcataagtttttaatttgtcatcatgacctggaacacttggatttaagaatgatgaagctggttcagcagcaccatttaatacagtactacataattctttacggttaatagctaatgagattgcttctctaactgctttattacttaatactggatcattatctttaattgataagaaatatgtacctaatggagttacttgagtaatttcatcttttaaatcactatctttatattgatctaataatgaagtatctaagtcacacatatcaatgttaccttgttcatattccatcatttttgtacttgcatcatcaatataaacaatttctaaacgatctaagttagcttttttaccatgatattttttatttggtaccattacaactttagtttgttcatcattttctttaattacataaggaccagtaccaattaagttagttcctttaccccagttttcaccagcagcagcacatgcatctgaaggataaattgaagcatagtccatacctaagttagcaacaaatggcgcaaatttgtaatcaatatgtaatttaaaagtgtaatcatcaactgtttcaaaaccacttaattcagtagctttaccatctaacatatcttgagcaccagtaatcatgttgtacatatatgtatttgtacatcctgttgctggtgtaaacattctttcgaatgtatatttaacatcttcagtagttaaatcagaaccatctgagaatttaacaccttttttaagtgtaattgtataagttaatccatcatcagatacctctggcatatctttagcaagaacacattcttctttattatcatcattccaacgatataatccctctaatacgttgtcagcaacagaagaagcccctgaagtagtgttagtttgcatatctaaaccaacttttggattagattgaccaaagcgaaatactttttcgccactttctgtacttttgcttgagctacttgaaccaccacatccagctaaggatacagccattgcagcaacagcaagaacagataaagatttctttaataagttcatttccctttcctcctagttttaacaattccctacttaaactttcttaaagtacctttgtattatatcaaaggggtttcttgatttcaacagaatattgcatttttgtatacaattgaaaacaattatctaatttcataccttattattttatgtttttttgcaaaaaatgttcttgtttatgcaaaaaaacaatatccaatccacatggatattgtttttcattttaaagcatacttgtcattccaccatcaataacaagtaattgtcctgttgtataagtacaagcgtcacttgcaaaatagataagtgctccgttcatttcaccttcacgaccaaatctcttaagagctactctgttttttaaaacaagagaacctggtgcatctaaagcatcatgtgtcatttctgtatcatagacacctggtgcaatcgcattaacaagaataccataaggtgctagatctcctgccatggcttttgtaaggttaacaaccccacctttagccgcaaaataactcacttgagcaggtccagcttgaataccaccaaccgatgaaatattaataattcttccatatttttgtttcatcataatagttgaaacttctcttgccatgaggaaaacaccttttaaatctgtatctaaaactttatcccattgggctgttgtatgatcatgaagaccacttgagtattcaacaacaccagcattatttacaagaatatcaatttttccaaaatgattgacgacagcattaaccgcatttttaatactttcttcatctgtaacatcacatgaaacaggtaaacaatcatgtccattttgttttaattctttagaaaattcttctaatctttcttttctacgtgcaaggatagcgacatcgcatccttgttcacttaatgctcttgcaaattgttgtccaagcccacttgaagctcctgtaacaaccgctacttttccagttaaatcaaatgttatcatgattatatctcctattccatcacacgaattgcatgatatccttcatgaattgcagttaaaatttttcttggtgcaacagcatctccaataacagcaacttcatcatatttttcatctaataaatcttctaattgattattaggtctaaatccaacagcatttaaaacagtatcacattcaagcgtcattgtttttccatctctttcaaatgtaacacttgttggtgtaatatttgttactttagcatttgcttcaactttaacgccacgatctttaaccatttttcttaaatgttgatcattatttaagcaatggttcgctgtaaataagatgtctggacacatttctactaatgtgacatctccatcttttccagcaatatcacaagcagcttctgttccagcaagtccagcaccgataacaacgacttttttaccaactgttgcttgatgtgttaaataatcacttgcaagaactgttgtatcaatacctggaattggaggcattgctggtgtagatcctgcagctaggataactttatcataatcaccttcaagattatctttagtaataggtgaatttaaatgaatattcacatctagttttttacattgtgtttctaagtatttaattaattttaaaacatcagctttaaaatcaggtccacctgctggccataaagtaccacctaatttatcttctttttcatataaatcaacatcaaaaccacgacgttttgcagtaatagcagccatcataccagctggacctccaccaataactaatacattacgtttttgaccatttagaagtggtaaagcataagctttttctgcgtaacataatgggtttactgcacaatagtagtgttttccactaaatccagcaagtaaacattcattacatccaacacatggagcgatatcttcttcatgatgtgctttaacttttttaggccaatatggatcagctaacatttgatgtgcaagtcctacataatctaagattccatcttcaacagcttttttagctacttcaggatcttttaagttaccatctcctaaaacaggtacacttacaatatctttaattgctttttgaacatctaatttatatccttctttactataaacagtagtgattgcttggaaccattcttcataacatccagtatcaacatgtaaagcatcaacccctgctttttctaagattttagccatttcaataccttcatcaattgttctaaaaccttctactctttgatgtggtgtgaatttaaccaaaactggcattgtttcaggaatattctttttaattgcttcaatacattccaatgtaaaacgcatacgattttcaagtgttccaccatattcatctgttctattattccattgaacagaatggaattgatctaataaatatcctccatacgcatgtaattcaacgcagtctgcaccagcatttacagcaagtgaagcactgtaccctactttttctactaaataatgaatatcttcttttgaaaaaggtttacaaattaaatctgggaaccagaatgctcctacactacccgcactataaggtggtgtaaaaggatcagtaaattgttgacgtcctaaacctggtgataattgtacacagacttttgctccataagcatgacatctttcaattaacatatttaatctttctacatgatggaaatcagaaagttctgtacatggtcttggttcatattttgtcgaaacaacgttagcacctgtaataattaaaccagcgccaccttttgctctttcttcaaaataatcaataccttcattacagtaagctccatcagcttctcctgtcgttcccataggtgacatgaaaattctgttttttaatttcatttttcctatgtatgtcttatcaaataaactcttagccatttcttttccctcctcataccatagtaaatgtttatttaacttaagtaaattataaaactctaaaattaaatgtcaacgctttcaatgaataaaagtgaattttttaacaaactctttacatgaaatatatgttatattatttttaaggagaattttatgaaaattacgagagaagaaatatcagatactgcagttaagctttttttagataaaggatataataatgtaaccatccaagatatctgtaatgaattaaatattactaaacctactttatataaatatataagtaataaagaagatcttattttagatctttatgattcaacgattgatcatcttgttaaagatacttataaacttgttgatagtgatagtcactatcaacaattactgattgtattttcaactttaattaaagatacaaagaaatatggttacgatttatttagtcaaatgtttatcgctaatttaaaagaaaatagaaatagctttgcgatgagagaaaatcttacaaaactatgtatcatcatcataaaaaaagctcaaaaaaataaagaaattcacaatctttccaatcctgaatttctttaccaagctttagctcatacttttacaggtcatgaagctttatggtgtattaaaaaagaagaaaaatgttttgatgaatctttttatttaagtatgaatgctttattagaagttgatcctgcttatcaagatttatataaagagtatttgtaaaccttttattttattgatagaatagtcgaggtgataaaaaatgttgatagaatgttcaaatataaagaaatcatttcaaggaattgatttattaaaagatattagttttaaagtagatgaccatgataaaattgcgattattggtgtcaatggagctggtaaaacaacgattttaaatatcttaattggtgaagaaagttatgatagtggtgatttatttaaaagtcgtgatttaaatgtaggttatttaaaacaacatcatgatttagatatgaataaaaccatctatgaatgtgctttagaagtctttgaacctttgattaaaatagaaaatcgtatgcgtgaattagaaggcatcatggcttatgatcatagtgatcaagtcatgaatgaatatgattcacttacaaataggtttaatgaaaaagatggttttagttatcctagtcgtattgttggtgttttaaaaggaatgggctttgtggaagaagattttcaaaaatatgtttatgaactatctggtggtcaaaaaaccagactttgtcttgccaagcttttattagaagagcctaaacttttggttttagatgaaccaaccaaccatttagatagtcaagctatttcctttttagaaaactatttaaagggttataaaaatgctttgattgtggtcagccatgaccgttattttattgatgttgtttccaataagattattgaaatagaaaatggaaaaagtcatagttataattgtcgctatgaagaatattctattcaaaaaagaacacaacgtgctattgatttaaaacactatatcaatcaacaaaaagaaataaaaaaaatacaagaaagtattgatacattaaaatcattcaatcgtgaaaaaagtattaaacgtgcagaatccaaagaaaaacaacttgcaaagattgaacgtattgatcgaccagaaaatttaccaagtgccatcactgttcaatttacaccagctattgaatcaggttatgatgttttaaaagtcactgatttatcaatgcgttatgatcaaatggtttttgaacactgtaatcttgatattaaaaaaggagaacgtgtggctattgtaggggaaaatggtgttggtaaaacaactttatttaaagcccttgtaggtcaacttcctattgatcatggaaaaatacgttttggtagtcatgtagaaatggcttactatgatcaagaacatgaatctttaaactataacaaaacaatttttgatgaaattagtgattgttatccacgtatgactaatcaagaaattagaagtacccttgctatgtttaactttagaggcgatgatgtctttaaagatattgccatgctttctggtggagaaagaggacgtgttgttttaacagaagttttattaaaacaagccaacttcttaattcttgatgaaccaaccaaccacttagacatttcttctaaagaagtcctagaagaagctttaaagagctttgaaggaacgattttatttattagtcatgatcgttattttataaacaaaattgcaacgcgtgtgattgaagtacaaaaagatcaatgtctttcttataatggtaattatgatgattatttagctcaaaagacacctgttgtagagacaacacaaaaagtggttaccgaagcaagacaaagacagatcattgataaaaaaacaaagaatgaaattaaaaagcttgaaagaacgattgattctttagaaaaagaaattaattctttaaaagaggaactaacaagtgaagaagtcatgaataattataaaaaatataatgaaattactgattctattgatgaaaaagaaatggaattaatggaaatcatggaaaaatgggaacagctacaatcgtaactgttctatttttttcatattttaaaaaaaataaatatatttttataaattatgtataataccattgaatttaaggaggatatataaatgttacacaaaactttaaaaccatttcctaaagatttcctttggggagcaagtacaagtgcttatcaagtagaaggtgctagtttagaagatggaaaaggtccatcatgtcaagatgtaaaagttgtaccagaagggacttctgatttaaaagtctgtgcagatcaatatcatagatataaagaagatatcgctttaatggcagaaatgggattcaaaacttaccgtttctcaatttcttggtcaagaattattcctgaaggaacaggggctatcaaccctaaagggattgaatactacaacaatgtcatcaatgaatgtttaaaatatggaattgaaccattagtaactatgttccatttcgatatgcctgcagcattagatgaacgtggttcatggggaaacagagactcaattgattggttcttaaacttcgcaaaagttatgtttgaaaactttggtgatcgtgttaaatattggttaacaatcaatgaacaaaacatgttaactttagttggaccagttattggaacattaatgattcctgaaggatgtacaaatgttttaaaagaaacttaccaacaaaaccaccatatgttagtagcacaagcaaaagcgatggctttatgtcatgaaatgttaccaggagctaaaattggtcctgcaccaaatatctcattagtttacccagcaagctgtaaacctgaagatgttttagctgctcaaaactataacgctattagaaactggttatacttggatatggctgtatatggtgtttataacaacttagtatgggcttatttagaagaacatgatgcatgtcctgaatttggtgaaggtgacgaggaagcattaaagagtggtcatcctgatttcatcggtttcaactattataatactgctactgtagaagcaagtgatggaactgaaaaattagatccaggtgcagatcaacaaactgctcgtggtgaagctggtgtttatagaggatataaaaaccctaacttaccaactactgaattcggttgggaaatcgatcctatgggattcagagcaacaattcgtgaaatgtattcaagatatcgtttaccaatgatcgttactgaaaatggtttaggagcttatgatactttaactgaagatggtaaagttcatgatcaatacagaattgaatacctaagaaaacacatcgaacaaattcatttagctatttctgatggagcagaaatgatgggatattgcccatggtcagcaattgacttaatttcaactcatgaaggtatggttaaacgttatggatttatttatgtagatcgtgatgaatttgacttaaaaacattagatcgttataaaaaagattcattctattggtataaaaaagtgattgcttctaacggagaagatttaactgactaataattaagtattttaaaaagaagtttaactttgttaagcttctttttctactattataaagcaaaaaattacgaattattgcttcgtaattttttagtaatattttaattattttgttatagattttttatttttattgtgaatatactcagccattacagccatactaatacttcctgttacaacatataaataaacatggtttgtatcgcctgttttaactgcacttgtttttttaacaggttcattttttatcgtattttctacaggtgtttttatttcatcatttaaagattgtttagctgtccattgccataaatgttctccattatttgctggctcatttttagctgtatgaatccaagaactatgtccacctgtttcatatgtagttaatatagcacctttatcttttaataaagtataaactcttaatgcactttcttcgtatttaactgttgtatcatctttagcttgaataacccatgttggtatattaattgattttatctcttcatctgtaattattctaccttcaccatatgtctttatgttttgttgatcaatagctggacatgttgatactactgcagcaaataaatttggattatgtacaaccatatctaatgccatataccctcctgctgaacatccataagaatatattctatttgaatcaatattattattttttataatattattaatcaattttgttgcatcatcaatattttctgaccattcatgtggagtttgaggtgccaatacatatgctccattaaaaatattttgtgcttcatcgcttgctaaagcaacagctcctctatttgcttttaattgagaaagattattatagtgcaatcctctaaatccagattctccacctccatgaaaccatactataagtgggtgtttattcccatcatttgcattattaggtgtataaaattgatattttaatccatttgattcacctgcactaaatttatcaatttcttcatttatgattttttcattttgtaaaaattgaatattacttaattcacttccatcttttaatggtaatccttcattcaaagtaattgtatactttatattcaataaagaattacacccttttaacgttttagaatttgcagtaaaatctaatgtgtttttcccttttgtttctttattggtcactaagtgtaaaataatatttccatttttttcttctacactttcaacttctctttcttcatctttataagatcctaaatgttctaaaccagattgagaattaggaccaaaaaattcattttcaagttgactagaatatactgttgttcctgttgcatgaactttaaacatatcttttgttatcttactatgatcaatttctagattagatgttttcaaaacaacagaatctatagcttctccatcgtcataaactatagaatgtaaatcaaaattaacgttttgtccatctaatgcataaactggaataattgcaaaagagaacaacaacatcatactaaataaataagttgtaatttttttcatgatacccttcctttctatatttaaaatatatagaaaataatagataaattatatttatttagtgactttctcgtcattaatatgtgactttctatattgtcctggtgtcaatttaaatatttttttaaaagaattaatgtattgtgtttcgttagaaaatcctgtattaaacgcaatatcagtaattgttttgttattcaattctaactcaattagtgatttatttaatctatattgagttaaataatctttaaatgaaatacctatttcttttttaaaaaatcttgaaaaatactctctagaatatccaaaacgttttgctacctcatatacaagcaattcttcattatagtggttattaacatattctaatatatctcttgtcttttctgttttaatcattttacgttcatttttacaattttcgtataaaaaaattaacatttccagtgtcaccattaatatgttcatatatttggtagattgattacttatataaaagctataaatatctatcatatattttgttattttcttatttaaaaacggctcgtcaatattgaaatatatattcttaatatcaggtatcattttctttaaaaattcgtaatttatatgcattgtatatcctacaattttttcatcaaattctttatattgaggtatagaataatgaatttcttcacaatttgatatattcacttcattcttataacgaatccttttcatcccatcattaaaaaaaataacttttccttcaaacactattgataattctaaagacctatgccaatgtgctgtacaaattttacataggctttttttatgaggataaatacttataggtaaattattcattgtttttgttatttcataatatattttttgcattttccctccgacttaaaaatcaatcaattgagttattattttttaatagcattttttatatgtcttaaatttaaaattttctaaaacgcttattacacgccctatgtagaaagctgaaaatacagttcctataccaacaccataaatagaactatgacaaataagacaaataatgattgttgctagaatcatactaatatcaaagatgttcttacataaagaataaggtctatggaaaacttctgaaatacttaataccaaaccatcaacaggtgtcataattaaatttcctttaatcataaaatacacacctattgcacaacacgtattccctattaataacacaaggatttgtgtataaagatttaaatttattgtaggtattatatattgatataaatctaccaaaaaaccaaaaataaaagaaaacggaatttctaaaataaacttcatactgatttttctttcaagaatcatttgaatacaaacgaagattaaataaaaaacaatatttgcttgtccaaatgttagaaaagttaaaaaacttaccgcataaggaagtgtactaaaggcccctactcctaaatcagataatgtattacatgtaatccctaaaactaatatattcattcctaataaataatataaatatcttttcatatcatccctcttttcattcttattttataaacctctttaataactttccaatattattatttcatattataataactataagttatgaggtgattttatgaatattagacaacttcaatattttgttgatttaagtgaaacacttaattttacaaaaacagctcaaaatttttatattagtcaaacagctattactaaacaaattcagtgtttagaaggtgatttagatattcctttatttcatcggtcaaagaaatctgtttctcttacaagtgaaggacaagcatacttgccatatgccaagaaaatattagaggatattgatttaagttataaagtcatagaagaatatcgaagaggaaagcgttgtactttttctattggttttattaaatcattagatgatgaattacttttaaacttattacaaaaaataaaagaaaattaccctttgattcatctacaatatcaagcttattcacgtttagaactattacatttatttaaagaaagaaaactagatgcgattattacttttgaatatcctgaaataaaagatgaaaatcatcttttattaaaaaaaggtcatttaagaaaatattaccatcaagattgttctctaaataatttaaaacttatctatgatgtaagacaagaatcgctagaaaactatgaaatcgaacaaacacttttaaaagtatgtttaaaagaaggatatgctattttacatgattttatcgaatcaaatcagtattctaaatatcttcaatatcaagatttagatatttcctctcctatttccttctactaccatttaaattctacgaataaaatcttacaaaacattattcagctaatagaaaaaggatagcctcgctatccttctatatttgttataaattctatttcttgatcacattcaaaatattgttcagtttcttcaacaatttcttttcttaaaccaattaaaccaactaagtttggaattgccatacaaccattaacaatatccgctaaaacaaagataaattccaaagacataaatggtccaattgtaataaatgtaataaaaacaattttataaatctttacagcttttaatcctttaagataatacatacatctttcaccataataattccatccaataattgttgtaaaggcaaagaatacaagaccaatattgacaatatatttaccaattaatggaacaaatagtcccactgaaaatgcatgtgttgtcatcgctgcaccatctaatcctgttgtataagattgtgtcaacacgatagcaagacctgtcattgtacaaataacaatcgtatcaataaatgtccctgtcattgaaactagtccttgttctacacaagaatctgtctttgctgcagctgccgcaattggagcacttccaagtccactttcattcgagaaaatacctcgactaattcccttttgcatcgcaataaccatagtaattccagttcctccaccaaaaactgcttgaggtctaaaagctgatttaataattaaagcaatagtacttggtaatactgtaatatgtgacacaagtattaaaacaacccctccaatgtataaaacgcacataaatggaataactttttctgccaccgaagcaattcttttgattcctccaatggtaataaaagcaactgcaattgttagaagaattgctgttatgtaacgtggaatgctaaatgacatagtaagagcatcagaaattgattttacttgcgtaaatgttccaattccaagtaatgccacactgactccaaagaaagcaaaaatttttgcaagcaaaggactatgtagacctttttctaaataatacattggtcctcctgcaatctcaccattttcatctttttgacgataacgaattgcaagtaacccttcggaatatttagtagccatcccaaaaaaggctgaaatccacatccaaaataaagcaccgggtcctcctgccgcaattgctgtagcaactccgacaatgtttcctgtccctatcgttgaagaaagtgcagtacataaagcttgaaagctactgacatctccatctccttcttgttttttaaagatgcatttaaaagctaattttaattttgtaagttggatcaatcttaatttgaaggtaaagtaaatacctgtccctaataacagacaaataagtggtaatccccatacataatcattaatttgttttaatatttgtgttagtaattgcataaaaaaactcctcctaataaattagtcggaattaataatgaaaaaatactatttagccactgtccttttacctgagagtttcaccctaacgggcttgctccttcggtgttcaattgaatgaatctctccaatggttcgtccaatagcgatccttttacctgaaatctttaattcttcggtgttcttatagaatctctttcgccattatcatccgatatacgttttcattatatcaaattgtatacaattgtaaacatttattttataattattatttgttataatgcagctatgaagaaaaataaatacttaatacttacaattctttggatgatttttatctttgtgatgtcacaaactccaggaaatgattcttctaaacaaagtaattttattgtggatatcattattcacatacttccaattacaagagataccctttccttcattgtaagaaaatgtgcgcatatgacagaatatgccattcttgcatttttaatttataaaacaattgtacatattgaaaaatcattagtaaaatcattcatttttacatttttatatgcttgcacagatgaatttcatcaactctttattgctggtagagctggacaatttagggatgtatgtattgattctacaggtgcactgattatgattttaattatttatatcattaataaaagaaaggacaaaaaaatcggttcatagaaccgatttttgtatatatattaaataccaaataataagtctacataagttggaattggccaataagaatcatctactaattcttcaattgtatcaattgtttctcttaatgattgcataataccgaagacatcatctctccacatagtagcaacttcaaagatttcagcatcattattttgagcttttgagatgttatcttctaatgttgttaatttatctttagcttcttgtaataatgttgcaagttttgttgcatcttcagttaagaatgctgctggaatacctgcttcttttgcagcaacaacttctgacgacactttagctaaataatcacaagctgctggataaatttgtgttttaaccattttaactgcagttaaagcttcaacttgaattgttttaatatagttatctaataagatttcataacgtgaagcgatttctacttttgtataaacaccttgacgatctaacatatcaatatattttggatcttttaagcatttcaaagcatcaacagtgtttttgtggttaggaagtccacgtctttttgcttcttcttcccattcagctgaatatccatcaccattgaagataattctcttatgttcagaaataaattctttaataacttcttcaaatgattttccaccttcaatagcatcagccatttgtgtcatttcttcagctaacatagaatttaaaattgtgttaggcccagctacagattgtgcagaaccaacagcacggaattcaaatttattacctgtaaaggcaaatggtgaagttctgttacgatctgtattatctttagagaaagttggtactacagaaacacctgtatcaaaacgtccaatttcttcatgatcagattttttaccagtacaaatatcttctactactttatctaattcttcacctaagaacatagaaatgattgctggtggtgcttcgttagctcctaaacgatgatcgtttccagcagaagcaattgacatacgtaagatttcagcatattcatcaacagctttgattgtacaagctaatgcagctaagaatggtttattttcttcaggattttttcctggattaaataagttgattcctgtattagtaattactgaccagttatcatgtttaccagaaccattaactccagcaaatggtttttcatgtaataaacaacgtaaaccatgttttttagcgatatcttgagcaatttgcattaataaatgattgttatcagttgtgatattaactttagaataaacacatgcaacttcatgttgtgcaggtgctacttcattatgttttgttttagatggaattccatatttccataattcagtatctaaatctttcataaaagcagcaactttacgttttaaagaaccgaagtaatgatcttctaattcttgcccttttggtgccatagctccaaataaagttctaccagttaattttaaatccatacgttcttgataatatttatcatcaactaagaaatattcttgttcagcccctactgaagcagaaactttagttaccccttcaaccccaattaaaggtaacaaacgacaagctgctttacttaatgcatcacatgatctaagtaaaggtgttttcttatctaatgcttccccagtatatgaacagaataacgttggaatatataatgttccatctttaacgaatgcaggtgatgtacaatcccatgctgtatatcctcttgcttcgaaagtagctcttaaaccacctgatggaaatgaagaagcatcaggttctccttttcttaatgttttcccactaaattctaaaacagcttttgacccatctggttctaagaaagcatcatgcttttctgcagttaatcctgtcattggtgtaaaccagtgagtaaaatgtgtagctccatgttcaactgcccaaattttcattgcattcgcaataacagttgcacattcttttgataattcttcgcctttatcaagcgattcatggaatgctttatatgttgatttaggaattctttccttcataacatcatcagtaaaagctaggcatccataatcttcaactaacttgttaaattccatctttgtatcccccttatttagtatataaattattatttatatgatgtcattatacaaacgaaaatataggttgtcaacaactattacaaagtttttatcattttgataattttttatttattttatacaaaaaaagagctgcatactattgagcagcagttcttttagctttcttttcttcttttcttcttttcttttcccatttacgatgagtttggttatattcttcaacttgacagtgaattctcttatttgaatgaacaacagcatccacaaatcccatttgatcttttggagcaactgtttgacgagttccatcatccatatagatttcatatgaatgtgcatttgtaatgatctttgtcattttagcgattggatctgtaattgtttcacagttcattaagttaatttcttttgtttttccaattcttctatgaatttctaaagttcttctttttacaacatatttataaggtctatatccaaataaatacccaatagcaatgacacctaatacaataactgcaggtaaatcactaaaattacccgaaacaatcatatacaccacatagattgcataaaatacactaaagtatgcagcaggtaaatttaattgaactttaaattctttttcaaatggtgttaattccgcatttgattcgactttttttgattccataaaaacccctctttaattctatactttcaatatttaataaatatcaattttctttaataaagtcaactcatattcattaaatatttttttaaaaaataagggacggggaatcccgcccttattcattatcttatttaatttatcaatattaagcttctgcagcttgtttgttttgatatttttcgtaagagattaagaatggtacatagataactgttgaaacaacaattaagattgcttgagttactgcacccattacgtatctcagctgcacgtctaaaacaacatctcttataaaaactataaaaggagctagccccctccctacgcttcgcttataggaaggggattgcgctcctatttttgttcaaattgttgaagttctgaaaaagaataaaattcattttcttgtaacatataataacgaatatgttgaatgagtgtttgaataaattttttttcataaaagagtttttctttttcattgtttggataattgatttgtacataattaatttctttatttgtaggaatgacgataatatggcacattccatagagttcttggtttaaaataaagggattaacaagacattttttatttttgtataagatgattattggtaaatgatatgatttttttaatagttgattgactgttctttcattaataaaatgaggtgttgattgtattggtaaatcatggtttttttgaatataattacttcctaaaatatttttagttttaaaatctttaatttctaagcttttatgtttttcttttaaagaatagtataaagaatgatcataattcaaatctttcatttagctactatcttaatttaagcacatatttcaataataaaaaagaactatcttttagatagttcgataacaggaatattttgaaattcttttttgatcatttgatgatctattaaagataataattttgatgatttaatttctaaatctaaagcaggatgtttataagatgaaagatttgtaattatatgataagaacatgtttttttgattgtttttaaatacttttgtcctttttgattcatttttaaaacatgaatataatcaataggaaaacagtttttgatttcatcctttgtattattcattaaaatgtgtaataacattctttggattctagtttttgtataacgtttacttgtaagcgaatttacaagttcttcataactattagtatcaaagataactttctttaataagttctctatgccttcatcaacaagatggatcttttttaattgtgtagggctttgaatgataatttgatatttcaaataatcaaagaaatcattttgatgataaagcgaatcataataagacatatctaatagataatcatgaacatcttgtttttcttttaaagctttacgtaaagctgtagcagaagcaatttttgtaagtgtagtatcatgataatcattggatcttttaatacaatggagacaaataggataatcatgattgatgacttctttaacatatcctaaacctaataaatcattaggggtttgaatacttttatttagtaataaacttaaagcttgattacaagcatcagggtaacgtaatccttttttcatagcagctttaacatattgatcatattcattaggatgatttttaatagcataggcaatttctttaaaagtatcgatgtcaccacattcactaccaaaaacaagatcagtaattcctatatgataaagtaaatcaatcgctcctttacaaaaataatcggcactttgacaaacatatgcaaaagggagttcgataactaaatcaacaccgtatttaatagcaagttcacttcttttaaatttatcaataattgcgacttctcctcgttgaacataattaccagacataatagcaattgttaaatcgggctttaccatttcttttgctttttgtaagtgataaagatgtccggtatgaaaagggttatattcaacaatgattcctaatattttcataaatgatagtccttttgtttaatggttttaataactttaaagaaagttgaaacaattaaaattgcagttgcaagtgctagagctgttcctactgtttgaaaaagagaatcaagaaataaatcttgatcatgtgaaatcaaataaagcattgtttggtaaattcctttcccagggacaatagggaaacaaccaacaacaataaaaatagttgcaggagctttacatattcttgccataatttcactaaataaagctacaacgatcatcgcacataaatttgacataatattacttagatagggtatcaccagtaaataaacgatccatcctagcatcccaccaagagaagctaaaagtgcataaggcagatgacgatgtactctaaaaacaaaagcaaatcctaaacaccctaagaaagcacttaaacattgaattacttgttccattaaatcaatcctttcaataaaatacgtatcaatccaactcctaaagcaattgctgttgcaataaaaaaagcttcaacaagacgtgcttgcccggaaacatagtttccatcgataatatctcttaaactattggtaattgcaattccaggagttaaaatcattagacaaccaataattgtcgcatctagattataaatcaaatgaaaatgataaaacaaaatcgctaagatagttaaaaacatacttgttagtgttgtacgcattaatgaattaattcctaaaatctcattgatccatataaaaaaatacattaaaaaacctatgattccagcaataattccttcatgaagtccacctccaaaaaaaatagcataacctccagcccctaaaccataccctaaaagaacaagtggcatgatagggtgtaaggaattgatagcctgtatttgttgttcaataaaatcattagtaggtgtttcattacagatttttctaacaagatcatttaaagcacaaacagcatcaaggtttgtacgattttgtaaagttcttttagtaagagaagtacttgttccatcttgaaaagtaacactcattgtaaaataagtaggaagagcaaaaacacctatatcttgaaagccatagctttgacacatacgttctagactttcttctacacggtaaatttcagcaccatttttaagtaataatttaccgatttcagcaatattttttattaataattgttcgttcatttttttatttcaccaaaagttagtataacaattattaagtatttaggaaagaaaaaaagtatgtttaaaaggtattttttaaaaaaataaaaacagattgcaaagatataaaaattaggtataataacttttgacaaagtaggtgaaataaatggaaagattacaaaaatatattgcttcaagtggttatacatcaagaagaaaagcagaagatttaattagagaaggtagagtttctgttaatggtcaagttgtaactgaacttggaactaaagttaaatctggagatgttgttttaattgatggagaagctattgttggtgaaaataaagtttattatcttttttacaaaccacaaggatgtgtttgtacattagatgatgagttcgatagaccaaaagtaattgattacttcgaagaagttgaagaaagaatttatcctgttggacgtttagatttcgatacaacaggtgctttaattatgtctaatgatggtgattttgcaaatatgatcatgcatccaagaagccacttagaaaaaatctatgaagtaacaattaaaggtcttattaaaggtgaagatttacatcatttagaaaaaggtgtttatttagaaggtaaaaaaacaatgccttgtaaaatcaaagtcacttataaagatatggaacataaaacaactgttttaaaaattaaactttatgaaggaaaaaacagacaagttaaaaaaatgtttgaaagtgtgggacatccagtaaaaagattacatcgtatttctgttggttgtgtcaatttaaaaggattacgtcctggagaatatcgtcgtttaaaaccacaagaagtaaaagatttaaaaaaattagttggaaaataaaattcgacatcatttttatgcgtgagtgcttatactaattgttggtgatggaaatgagagtacaaattattgatgataaacaattaaaaaactgtagtatttgtaaagcaacggatgaatgggtagaaaatatatgtgttaatgggattgaaggattatattgtgttaaatgtgatacgctcacattgtatgaaccccttccttcaaaacttgtttatttagcttttaagaaaaaatgtatgcaaataaaagaaatgaaaaccaataatcagttgacaatgtaaaatattgtattagaataaaaacgtaaataaaaaaagcaatgatttaggatatgttttataaatgatttgatttagagaaaaggtggttggtgaaaaccttgagaatgtttataagatactccctaatagctacacttgaaaaagattgtcgttaactgcgttaaagttttgaggctgaaaagcaaattaaggtggtaccacgaaactctcgtcctttggatgagagttttttatgtaaaggagaaggaaaatggtagattttaaagaaaatgaacaattaaatacattaaatcactcttgtgcccatgtgatggcacaagcaatcaaacatctttatcctcaagctaaattttgggtaggtcctgttgtagctgaaggattctattatgatgtcgatttaggtgatgaagttgttagtgatgaagcaatcgctaaaattgaaaaagaaatgaaaaaaatctgtaaagatggtaaaagaattgttcgtcgtgaaatttctaaagaagaagctttagaaatgtttaaagatgatgaatataaattagatttaatttctaatttaaaagatggaacaattacttgttatagtcaaggagattttactgatttatgtagaggtcctcatgttgaaacagttaaaatgtgtaaaaactttaaattaatcaaacattctggtgcttattggaaaggtgataaaaacaataaagttttacaacgtatttatggtgtttgtttcccaactgctgaagaattagaagaacacttaaatttattagaagaagctaaagaaagagatcatcgtaaaattggtaaagaaatggaaatcttcatggttgatgatttaattggtagaggtcttccaatgtatttaccaaaaggatatgctatctggcaaaaacttgaaagatacatcaaacaaaaagaaaagaaattaggttacttacatgtattaactcctgctgtaggaacagtaaacttatataaaacatcaggacactgggatcattataaagaaaatatgttcccacaaatggaaatggatggagaatcatttgttttacgtccaatgaactgtcctcatcatatgatgatttatgcaaataaattacattcttataaaaacttaccaattcgtattggtgaaattgctcatgactttagatatgaagcatcaggagctgttaaaggtattgaaagaggaagacatttctgtcaaaacgatgctcatttatttgtaacaccagaacaaattaaatcagaatttaaaggtgttatcgatttaatcttagatgtttataaagatttcaatattacagattatcgttgtgttttatctcttagagatccagaagataaagaaaaatatcatgatgatgatgaaatgtggaataaagcagaaaatgaattacgtgaagtaatgaatgaacttggtattgaatatactgaagaaattggggaagctgctttctatggtcctaaattagacgttaatgttaaaccagctattggtaatgaaatcactttatcaacttgtcaattagacttctgtttaccagctaagtttaacttaacttatgttgcggaagatggaactaagaaaactcctgttgttttacacagagctattttaggttcattagatcgtttcatggcttatatcttagaagaaacaaaaggaaacttaccattatggttagctcctacacaagtcaaagtattacctgttaaaaatgaatatcatttagattatgctaatgaaatttatcaattattattagatgaaggttttgaagtagaacttgattcaagagatgaaaaattaggatatcgtattcgtgaagcacaaatgcaaaaagcaaactatatccttgttttaggtaataatgaacgtgatgaaagaactgtaacttatcgtaaacatggtgaacaaaaagcaacaactgttactattgatgagtttgtttcaatgttaaaacaacaaattaaagataaaaaatagtttatatttttaagatatggtatacgtagaagctcaatttttaaataaagaattgagctttttacataaaattgacaaaagaaaatactatttatataatactaatgagatagagtatctctataaagtgaggaaattatgataataaaaaagtcagaaaaagatgaacgcagagagaaaattatagatgttgcttttcgtctttttgtagataaaaaaatcgaatctgtaacaatgggagaaatagcaaaagaagcaggaattggaagagcaacattgtttcgttatttcccaggaaaattagaacttgttattgcggtaaatacaaaagaatggaaagaatattttgatgaattagatcaaaaaagaccaatgagttcagtaggagatataccagctattggtcgtttgatttttacattagatagttttattgaaatgtatcaaacgcataaagctcttcttcggtataatgataatttcaatcattatgtatctcattcaggaagaaaagatttacaaatggatgaatttaatcaagcacttttttcagcaaatacacgttttcatatgatgtatgaaaaagccaaagaagataaaacgtttaaaacagatatggcagaagaagagtttatgagagtaacagttcatacaatgatgacagcttgtgcatattatgcaggaggttttatttggggttctaaagaaaatgaagactacacaccagagttgatcaaattaaaagaaatgattcttgcatatgtcaaagcataaatagataataaaatttatatatttgataagtgtttatatttttaagaaaatatttataaaaacaggtaaagttttaaaatttaaaagaataggattgtttacaatcaatgttttgcgggtggtaaaaacgatggataacgcatgtagagggtatcgaaaagatacctttttataaaaaataataaggagtgttcttatgaaaaacatcgaagaattatcaaagaaaataaaacttacagaaactgagaaagaaatgtttgaattattgtcgataccatggaatccatgtattaaaaatagatgaataatcttaataaatcaattgtattttgagacaaaaattgctattataacagtggagaaattgtcttcaaaaatcaggagattccctgccaaatagtgggagctaaaaaatcaggagattcccctagctccttttatagtttttataagagatgttgttttagacgtgcagctgagatatactataagtataaaagacgttcagtcgtacttgattttagaaaggatattgctatggaacttgatactaataatcattcagtattcatgcttaattatcatttaattatgtgtgtcaaatacaggaataatgttattgatgatgctatctcattacggcttaaagagatatttaaaaacatatgccttaattataatatttcgttggaagaatggaatcacgataaagaccatgttcatgtactgttcagaggacagcctaatagtgagatttctaaatttatcaatgcttataaatcagcaagtagtagacttataaaaaaagaatatccagaaatcaagaaacacttatggaaggatatgttctggtcacaaagctattgtttgatatctacaggtggggtgaccgtagatattattaaggaatatattcaaacgcaaggaaggtaaaatatatgtcaaaagcaaacaaaagtaacaaggcaattaaatatagactctatccaaatgatgaacaaaaagtcatgtttgcaaaaacttttggttgctgtcgatttgtctataaccaattacttgccctgcaaaaacaaagatacaaagatggagaatcccatctttctaagcttaaatcaaatgagttcgctactcgtacattaaaaaaagattatgattttctcaaagaaatagataaatttgctgtttcaaatgccgtttttcatttagcagacgcctatgacagattttttaaaaaacaaaatcattttcctaaattcaaaagcaaaagaaaatctaaaaagtcgtatacaacaaattttacaaacaacaatattcttattggtaaaaatgtcataaagcttcctaaagttggaatggtcaaagctgttattcataagttgcctaaagatgattggaagcttaaatctgttactgtctctcaagatagtgtcggtaactattttgcttccgttcttttcgaatatgaacaggaagacattccatctgtttccaaatcaagtacaaatgctattggacttgactataaatctgatggactttatatggacagtaatgggaataaagcaggagttcataaatactatcgagaaagtcataagaagcttgctaaagagcaaagaagactttcacgaaaagcaggttctaaaaagaatgaaacaaaatcaagcaactattttaaacaaatgagaaaagtaaacagaatctatagaaaaatagcgaatcaacgtctcgacagtcttcataagaaatctactgagatagccaatcagtatgatatcgtatgtgtcgaagacttagatatgaaagctattggaaataaaggttttggcaatggaaaagcgacctttgacaacggttatggaatgtttcttaatatgcttgagtacaagcttaaagaaagaggtaaatattttgtaaaagttgacaagtggtacccttctagtcaaatctgtcattgctgtggaagtgtaaaaaaactcgacctaaaagaccgagtttatacatgtgattgtggttatactggagacagagaccataatgcagcaatcaatatacttacagaaggattgaggattcttcagtccttatagataaattataaaagtaggcttgggacgagccaaacttatacgcttgtggacactgtgtaagacctataatgtattgtcattagaggctgtagtggttgaagcaagaagctccgacttctaaacgaagtgtaagtcggagtagttcacgatgaccaccgagatgaccaccgagatgaccaccgagatgaccaccgagatgaccgccgaaagacaaccgagataaaaaatttttaaagggaatacaaaattagtattctctttttatatatttattatttgatacattgtaaaatatatgtaataaattgtttaaggagattcttctatgaatattacaggatataacttagaaacattgaggaaaaaaataagggatttacaagaagaaaataacaaattaaaagaattattaaaaaaatcaaatataatatttgatgaacaaacaaataatataacaaataatttaactgaatataatgaagatcaaggtgcttgtataaaagatcaatatattacaggtgaaatggctgctatttttttaacaatatttcaaggtaggagagacgtctatgcattaagaggttcacgaggtggttattttccgcaatgtaataatagatggaatagtatgtgtcctaaacaaaacaatgtaaaaacatcatgtacagattgtccgtataagcaatggaaagaattaaacagaaatgtaggattaaatcatttgcttggtcataaagataattgcacagatgtaataggtatttatcctcttttagaaaatgatacatgtaagtttattgtttttgattttgataatcatgatgaagagagtatagataataatgattggaaagatgaagtaaatgcgttaagaaaaatttgtgaagaaagtaatattgatgttttaatagaaaggtctcgttctggaaatggggcacatgcttggatagtattcaaagaatttatatcagcatctttagcaagagactttgactatttactaatagaaaaaggagctgcatcaattaacttaaaatcatttagatattatgatcgaatgtttcctacacaagatcataatcaagggcttggaaatgttataacacttccattacaaggtaaagcgttaaaaaatggtaatagtgcttttgttgatgaaaattggaatgcttattatgatcaatggttggttcttaataaaattaatagattaaccaaaaaagatgttgaaaggtatattgataaatggaagatcgaattagcagaaggtaaaggattattgataaatcctaatcgagaagcgagaattaagccatggaaaaaagatgagcctttttataaagaagatgttgtagaaaaaatgacaattgtgcttgctgatggtatttatattgatactttgaatttaagccctagaattcaaaatcaaataaggagtttagttgcttttgataatccaatattttataagaataatagattagggtactcgaattggaatcaaccaatggttgtttatatgggaagtgatattaatgactatattaaaattcctagaggattaatggaaaagattagtgataagtgctcacaggcaaacattccatatgagattattgataaaagagaaagaggaaaaccagtcaatgtagaatttaaaggacaattaaaagataatcagaatacagcagcaaatgaattattaaaatatgataatggtattttaaatgcaacaacagcgtttggaaaaacggttgttgcaagttaccttatttcaaaaagaaaagtaagtacattgattgttatgcaaagtgttagtttaattaatcaatgggtagaagagttacataaatttttagatataaatgaagaattaccaacctatcaaactaaaacgggaataattaaaacaaggaatgatgttataggggttctttatggaaataaaaacacgttaactgggataatagatgttgtatctgtcaattcaatttacgataaaaatggaaaaagtaagttaaaagattcttatggtatggtgatagttgatgaatgccatcatagtgcatcatctgtatttgaaaatgtattaaataaagtgaattcaaaatacgtttatggtgtttcagcaaatgataagagaatcgatcaattagaaaagaaagtttatatgttgataggatctataagacatcaattcacaagtagacaaaggatagaacaacaaaacattgatcattttatttatccgcgatttacacgagttattaatttaggtgatagtaaacaagatataaatagtgcgtattcattaatagcaaaaagcacaattagaaatgaaatgataatttcagatataaaagaatgtattaaaaataaaagaagtcctattgttttaactcgttataaggaacacgctaaatatttatatgatgttttaaagaaagatgtgcttgataatactttcttgatttatggtgataatactcaaaagaaaaataacgaagtaagaaaacaattgttagaaataaaccaaaatgaatcgtttattttggttgctacttcacaatctgtaggtgaagggtttaatgttccaagattagatacactttttcttacaacaccagtttcaggagaaccattagtagaacaatttttaggaagaattaatagagattatgaatttaaggaaagtgctatcgtatatgattatgtagatttacatattagcttttttaacaatatgtataaaaagaggctaagagcttatagaaaaattggtttcgacgttattacaaatgtagtgaataataaacaagaagctcatcatatttataattataatgattactctgaaatatttgctcaggacattcatgagtcaaataaggaaataattgtatgtagtccacaattagatgaaaagaaaatatttgaattcattgatttggtgaagaataaacaagaaaaaggagttacggtcattgttattacaagagatcctaataatttgcagtttgataatcctgattatgcaaattacttaatatatcatttaaaaatggcaggtataattgttgaattatgtgaaaacctagataatcattatgctattattgaccaagaaattgtatggcatgggggaattaatttattaggtagaccagatatttatgataatttaattagattaaaatccgttgatgttgcatcggagttgttaacgttagataaggatgaataagatcaatatgataatgataagagcgcgcgtgaataatatagattaaaaacaagcctcatacgcttgtttttaatatcctctcatatgccatatttgttcagtacagtcctcaatagaaagtgtttctttgtttttaataaagtctaaaaaatcattttcatttagattatcttgttctaaagttcctagaatgccagccatactaatatgatcaataccaaaatccttaagcatatgaattatttttctttgtgtttcatttatttttttcatattacccctcactattttttatcatttttatccagtttttgctggcaaattcaatttcatcttcataatcatcaaaatcattataataataaagttcatattctttatgatctataaagaaataaccatagttataattttctaattcaagttgaatgaaaatagaataattttcataattcatttgtaagaggagctgttttatttcttcttcatttttatttgtagataggatatgtatttgaccatcttttagatgaaaaggattatttttataaaaaggtttaatttgtatttttaatgtattcataagccacctcaaaaatattataagatatttttcaaaaactgaaagatttttgaaaaaagaaaaaaagaaagtatagtgtaaacgaggtggaaaaatgcgtagatttgaaagagaagtaatagattatgaattaataaaagcaatgttgaaggaaatgaatattgcaaatattggtatgaatgatgaagatgggtatccttatgttgttccaactaattttggttttgaaatgacagatacacatttaaatatttatactcattttatgaaggtaggaaaaaaggctgatttattaaagaaagatcctcgcgtatgtgttgagtttagtatttttaatgattttcctgataagaaatataaagggcattatcatgattatcgtagtgttatcgctaaaggaaagatgaagatgttagattataaagatgatcctgaaacttgggaaaagggatacaattttctttatacatgtaatcatcgtgagattaaacctttaagtgaaagaaaggttgtgcctgatatttatattggtgtgattgaatgtgatttaaaggatgttacggctaaatctgagtttcctttaaggacagttgaagatgttccttttttaaatgtttatgaacaagaggatgatgaaattcctttcgatatatcggatattattgcagatagaaaggctagaatgaagtaggagaatcgttttgattcttttttttagacaaattaaatgatatgtctaaatttatgtgaaaaaatcaacaaatatttaataaacaattacttaatagaggggtttcatgtataataaattggacgtaattgttttaattaaagaacaattaagggaggaaggaaaaatttaatgagtatgaaaaaatacgaggagtgggatgcaaatcacaagcatgacaatcctccaagagagaaaattgttaagttaggtagaaagattactgatgtggcagatcatatttttggtggcgtaaaagtagaagatccagaatattggggacttgctgaaattataagtgatgaaatggctgacattgctttacaaatgaaaaaacgtacaccttatacttttaaagaaatgtgtaagttatgtaagattgaaacgaatcaagaagaagcatttcaaaaattattagatgaaatgagttatattggtttacttgaatatgattatggttatcactatgatcataatggtcgcactgcaccacaaagtgaaagaagatatattttaccaatgtttgtacctggaagtgcagagttatttaatatggaagagttaccagatggatcaaatccacgtgtaacaaatcatccagatgtagctgctttttttgaacgtatgacttatattccgcttgcaggaattacacaaatggtaccaccaggtggtggaggaattggaatgcatgttattcctgttgaaaaagcgatttctatggaaaatgaagcgattgatatagaaaaattatcttattggttagataaatatgaaggtaaaattggtgtaggaagatgttcatgccgtgcttcaagaaaagcaattggtgatggatgtgctgatgatgattttggttggtgtatcggtgttggagattttgccgattattgtcgtgaaacaggcaaaggacatgatattactaaagaagaagctttagctattttaaaacgtgcagaagataatggttttgttcaccaaataacaaatattgatggtgaaaataaaatttttggtatttgtaactgtaatgttgaaatttgtaatgctttaagaacatcacaattatttaatacaccaaatatgtcacgttctgcttatgtagctcatgtagaaaaagataagtgtgtggcgtgtggaagatgtgtggaatattgcccagcaggtgctgtacgtttaggacaaaaattatgtaaaaaagacggttctgaaattaagtatccaaaacaagaattaccagatgctacaaaatggggaccagaaaaatacgattttaattatcgtgataataatagaattaatactcatgaaacaggaacagctccttgtaaaagtgcttgtcctgctcatattgcagtacaaggttatattaaaatggcatctcaaggaagatatcaagatgctttagcgctcattaaaaaacaaaatccattcccagctgtctgtggagcgatttgtaatagaagatgtgaagatgcttgtacacgtggtaaagtcgatgaagctttatcaatcgatgcaattaaaagatttattgctgaacaagatctaaatgccaaaacgagacatattccaaaagttgtgattcctgcaagtattcatatggatcattttgatgaaaaaattgcgattattggagcaggacctgctggtttaacagctgctttctatttagctgagacaggttatcgtcctacagtgtttgaaaaaagcgaacatccaggaggaatgttacgttatgggattccatcttataaactagaaaaagatttattagatgctgaaatcgatgtcgcaaaagcgatgggtgttgaaattaaaacaggaattgaagttggaaaagatgtaacaattcaacaattaagagaacaaggttataaagctttctatattgctattggatgcgctgctggtcgtttaccaggacttgaaaatgaaaacgcagaaggtgttatgacagctattgattatttacatgatgcaaactgtggtaatgcgccatttgctggaaaagttgttgtcgtcggtggtggaaatgtagccattgatgcttctcgtgtatctgcaagaaatgcagcaagttcagtattccaatttagcttagaacaagaaccagatatgccagcttcagttgaagaaatcaaagaagcaagagaagatggtgttacaatcaattgtggttggggaccaaaagaaattcttgtagaaaatggtaaagtaacaggtattgttttcaaaaaatgtttatctgtaattaatgatggtaaatttgctcctgtttatgatgaaaatgaaactatgacagttgaatgtgatcgtttaatatttgcgattggacaacaaagtgtatggaaagatttattaaaaggtgaagatgttaaattcaatggaccagctattgaattaaatcaagtgactttccaatcaagtaaagaagatatctttgctggaggagatgtttatactggacctaaattcgcaattgatgccattgcccaaggtaagattgctgctgaatcattacatcgttatgttcataatggacatatggaaacaggacgtaatcgttggcaatttaaacaacttgatacagatgatattttagtagaaagctatgatcgtggacctaaacaagttgaaggtattaacccagaagttaaagatcgattcaaagataatacacaaattcttacagaagaacaaattagaaaagaaacagcaagatgtttaggatgcggagcaacaatcgttgatgcgaataaatgtattggttgtggggtatgtacaactaaatgtgaatttgatgctatcaaacttcatcgtgatcatccagaatgttctaatatggttgtggcagaagataagtttaaagcaattatcccttatcaattaaaacgtgtaaaaaatattattttaaagaaaaaggtagaacattaagatgcatgaattaggtgttacattttatgttgttaaagatataaaaaaagttgcgcaagaaaataaagttgataaaattgattatgtgaagttagaaattggtgaagtttctggtgttgttcatgatcaattgattgattgttggaattgggcaagaaaaaaagaagcagtgacagaacatgcaaaaatgtatatagaaacattagaagcaattacttattgtgaagattgtcatggacaatatcgtacgattgattatggtaaaacatgtccttattgccatagtgaaaatacctatttattaagaggtaatgagtttaatattaaggagattggtatttatgaagattcttgaacttaaacaaaatatatttaaagaaaacgaagtaactgcagataaaattcgtgaagaatttaaaaaacaaaaaaaattaatgattaatgtgatgtcttctcccggttcggggaagacaaccacattacttcgtacgattgaaagattacaagataccactcgtataggtgttatggaatgtgacattgatgctagtgttgatgctgttacgatagaaaatggtggagcaaaagccattcaattacatacaggtggtatgtgtcatatggatgcaactatgactcaacaaggacttaatgaaatgggaatggatgatgtagatcttattttcattgaaaatgttggaaatcttgtttgtcctgcagaatttgatactggagcaagtattaatattacgattttatcagttcctgaaggggatgataaaccagctaagtatccattggtttatactgttagtgatgttgttttaattaataagatcgatacattacctgtctttgattttaataaagaattagtagaacaaagaatccatgaattaaatccaaatgctcaaatcttctatatttcttctaaaaaagatgaaggctttgaaccttggatcaattatctaaaagaaaaaatggaggaagtaaaccatggctaaagtaagagtaatcgaagttcatgaaaatatttttaatacgaataatcaagaagcagatgctcttcgcaaaagactaaaggacaaaaaagtgacaatgatcaatgtaatgtcttctcctggttctggaaaaacaacacttctttctcatgtaatcaatgaaattaaagatgattataaagtaggagtgatggatgttgatattgaaacatcacttgatgcacaaaaggtagcagattttacaggagttccttctattcaaattcataatgggggattatgtcatattgatgcagaaatgacaacaagagcagttgatgaatttggcgtagatgattttgatcttctctttttagagaatattggaaatcttgtttgtcctgcagaatttgatactggggcacataagaatatgatgattttatcagttcctgaaggagatgataaaccattaaagtatcctttaatgtttagtgtatgtgatttggttattatttctaagattgatacgcttgattattttgattttgatattgatcaagctaaagaaaatattttaaatttaaatccaaatgcaaaaattatctgtttaagtgcaaaaacaggtgaaggtatgaatgaatttattcaatggatcaaagaaaataaaaataattaaaaaggcatagttaggctatgctttttcatttaggtctttatttaaaatttctagaaaagcttcttcagctttagaaaacaaacgatactttttccaaataagattacttttaatcataagtggtggatttagtggtttaaaacataaagaactttcatttgtttcatgataaagatgttcaaaagttaaaacataaccaacaccctcttcacacatcaattgagcattataaaaaagattataagtagccacaacattaagtgctctttgattacctcctaaccatcctgcaatattatttttaaccatctcttgattagatataataattggctgattcattagatccttaggtgtaatgaaatctttatttgcaagattagaatccttttttataagaattccttcaaggtcataaccaggaagttttaaataatcatatttagaaaaatttgcaggttccacaacaatccctagatcaaaaatactttgatcaatcttttcttcaacatattgtgcatttccactataaagatgaaatttaatatggggatattgtttttgagttttagcgatagctttcataataacacgattacatatactttcactacatccaatatgaatatttccactaatatattttttattatttctaagataatcctcacttctatctacaagatttaaaatctcaatagcttgttccttaaataaccgtccttcttcggttaaagaaacagttcgcgttgtacgattaaaaagagttatttgatattcatcttctaaatctttaatttgtttagaaagtgcaggttgagagacattgagtactttagcggccttggagaaactttgttcctgtgcaactgttataaagtattttaagacacgtaattccattaaatcacctcatcataagtatatcattatttataattaaaaataataaatatctataatatataagtatttgtaattataaatcttcttttttacaatattcttgaaaaacaaggaggaaaattatgaatgcattatcaactttattcccagtattttttatgatcattttaggaatgatcgcgcgtattaaaaactttattagtcctaaacaaaaagaaggagccaatcatattgttttcaatgtattgtttcctatcttaatttttaatgttttatttactgctaaaatagaagcttcagcaatattgattgtgctatatgttttagttgcttttacattagctatggttttaggtaaatttatttctaaatttacaggaaaagaaatggaacatatttcaccttatcttttaacaactcgtgaaggaggaaatgttgcattaccactttatacatccattgtaggtgtagcttatgcaagcaatacagttatttatgatattgctggaacagtgattgcttttattattattcctgtacttgttgctaaaaagacatccggaaatacaagtactaaggaattattgaaaacaattttcacaaattcatttgtaattgcggttatgttaggaatcgttttaaatgttttaggtgtttatgatttattgtatcaaagtgcttttattgatgtttatacaaatacgattcaacaagcaacagcaccaattgtaagccttattttattaattatcggttataatttaaaaattaataaagatactattggttcattattaaaacttgttggagtaagaatcatcttctatattcttgtcgttgcaggattctttatcttcttcccccatttaatggcagataagatctatatgatgggtgtattgatttattttatgtgtccgacaggatttgcaatgcctatgttgatttcaccaatttataaaggtgaagaagatgaagactttgttgcagcctttatttcattattcatggttattacgttaattgtttatacatgtgtggttttatttgttgcatagtttgaaaatttcatatttttgacataaatatattttataataaagataattgaggaggaaaaaaagatgaaatttagtgaagatttttattggggtggagcagtagctgctaaccaatgtgaaggtgcatggaacgtagatggacgtggaatggcacgtacagatgtaacaacaggtggtacagtaaatacacctcgtatggtaacttttattgataaagatggaaataaacaaaaattaccaaatcatggatttaaattaccagaaggagctcattttgctgtctttgatgatgaactttatccaaatcatgatggtattgatttctatcatcattataaagaagatattgctttacttaaagaaatgggattcaagatgtttagattatctatctcttggtcaagaatctatccaacaggagaagaagataaacctaatcaagcaggattagatttctatagaaatgtatttactgaacttagaaatgcgggtattgaaccattagtttctatttggcattttgatacaccacttgctttagaagaaaaatatggagattggttagatcgtaaatatattgccctttatgaaaaatacgtaacaacaatctttaatgaatacaagggactcgttaaatattggttaacatttaatgaaatcaataatacagttaactttattcctgatgatgcaagtgatgaagtttatcaagaagcttatcaacatttacattatcaatttgtagcaagtgcaagagctgtacaaattggacatcaaattgatcctgaaaataaaattggatgtatgatttgtggcattacttattatccattaacatctgatccagaagatattttatttaatcgttctaaatgggaaaaaggtatcttctattgtggagatgttcaatgtaaaggtaaatatccaacatatgcgaaacgtttatggaaagaacataatgttaaattagatattactgaacaagatttagaagaactaaaaaaaggtacagtagatatgtatactttctcatactacatgtctcaagcagtaactactcatgaaaatgatgatgctgtaagtggaaatatgtcatttggtgtacgtaacccatatttagaatattctgattggggatgggcattagatcctaaaggattaagatactacttagaaatgatctatgatcgttatgaaaaaccattaatggttgtagaaaatggtttaggtgcttatgatacagtagaagaagatggaagtattcatgataattatcgtattgaatactatcgtgctcatattgaagaaatggcaaaagccattgaagatggtgtagaccttattggttatacgacttggggatgtattgatttagtttctgcaggaactggagaaatgagaaaacgttatggtttcatttacgttgataaacatgatgatggtagcggaacaatgaaaagaagtagaaaagattctttctattggtataaaaaagtcattgcttcacaaggagaagatttagattaaatatattagaagtttaactttttgggttaaacttcttttttattatttttagcactcacctcttgataatggaagttgatttttgttctgtcttgtgtatcctagaagtgcctgttttacgggctttccgaggcatcagtcattttgtctggtattgtaaagcagtgtcagatttgtcgtaaatgtcgtaaatttgtggtcaaaaaaaggatgagaaatggagagtgctaataaaatgaaattaacgtatacgaatgtaaacggatatctaatcccgaatctcacctataaatccggtgaacagatggagcaacttggcaagtatggttttcttcgcagagattatctgaaaaaccatcgaaattcaacctatcaggtgatgcttttacagaatacaattggagaacaccttctggaagtagatagggcagcaagagaacgggaaggagtgatcctgaaacagttggaagaaaaagaaccattaccggataaagagaaagatcagatggcatgggtaagagctgctaatcagcatagagcgattgcggaagagattattctcaaggaattgatttatgtattaatgttgctagtaaacaatttagcagataactaatgaaaatagaatattgtgagcgaagtaaggcgtgagtcatagaaatgtggcttgcgtctttttctttgcctaaaaggaagtgataagtttgaacaagaagttttgaagcattatatggaaaccaatccagaagggacagtacagacttatatctttctggtggacaatcaagatatcgcactgaatattgtgatgtcaggttatcaggcactttgtctggttcaggaagatgacggatattatttcagtgcagattcctttatagaagaaatgagagctattcagtttactggaagctgtcagtatgcctatcattatgtggcttcctgtacggtgaagtgggtaaatgataagttactgacattttttaaagacgctggtcttgatggaaaagcaggctggcagttgctcaaagagaaagagtatcttggcaaactggataatcagaaagaagttgagaaattactggaacagtatattcttcggtttgagcgaaatccgaaagaagaaccggaactgagccattttcacttatttgatgcaaaaggaaatgtgaaaggtgttcggaatatggagattgtagattatctggtggagaatgttcagttttttgtcgtgggaatcacaccttattattatgaacacggcgtttttctggaagaccatgatggggtaagaatgaaataccgtattcagaagctggtctatcgagatcaggtacagagtggcgtgatcaaaagaatctataatctgctgatcacacagccaaaagtctacagagaggcatatgaactaaataaacagcctgtgcggtggattaactttaaaaatggatattatgatccggttacgggtgaaatgctggaacacaatcctgattatctgacaatcaatcagattccatttccctattatccagaggattgtgagcaggtgttacaaggcggagaaaatatcaaaaagtatcttgcattgtctcttcctaataaagaagaacagcagatagcagaaaagaatgagagcagagaagctgtgccaagaactggcattgaagcaaatacagtagttaaggatgcggggaaagctgaaagaaaggcaataacagagaaaaagacaatgataggaaaagagaagaaactatcgatccatgaacacttgaaaaaatatgtacagctttgggcgtgacattatcgcagttttttcaggaaggtaattcagagaatctgacagaaaaatagaaagaagttctagggatatggaacgatctgagtacaaatgagcaggaaacagtaatgtcaatgctgcgtggacttcggaagtaggagaacagttcgagtatatgtatcggctgttctttttttgtttttgaacgttaaaacggtagtttttttcttgtgcatagtagaacgttaaagtataataaaattagtttttttggtataagtttaaaagctatatctataataaggaaatcggcaaaccagatgaaagtctgggacgcaaagctacagggcctgtaaaatggcagccagttgcatgaaatgaggtgcactgtctgtctgacggtgcttttttacggtgttatttcacagacgtaacaataatgattttatcaggaaagaatgaggaaaataaaagtatgaaaaaggcaaaacgttgtctgatagcagtggtgtcaggtgtacttgtagcaactgctgtcttgtctggatgtggacagtcaaagaaagaagtatctaaaaacgatgatcatcttacagtttatctgtgggaaaatcgtttgatgaaaaatattgcaccctatatccatgaacagtttcctgatcaggatattgaatttattattggtaacaatgataccgatttatacagttattttaaagaacatgatgaattaccggatatcataacagtacgtcgattttctggaacggatgcacaggacttacagccttatcttatggattttgcttcttatgatgttgtttctaagtattattcttatgcggtgcaatattataagaatgcggatgatgaaatccagtggctgccaatctgtggtattccgcagacgatcattgccaacaaaacactgtttgatcagtatggcgtaaagattccagaaaattatgaggaatatgtacaggcctgccagcagttttatgataatggcataaaaccgtattccatggatcttggtgaagactggtcaaataatgagatcatccaggcggcggcaatcggtgagttcacaagcctggatggtattgaatggcgaaacggtgcagagactgcatcggatgaagtaaagtttgatgatgcattatggaaacgtattttttcagaaaccagtcagtttctgaaagactcgcactttggtaaagaagatatcaatattgatgtcgatacaggaatccagatgtttgccgcaggaaaatcagcaatgtttcatggacatccgacggttatgcagcagctgcagaaacagatggatgcggagctgatccgtattccttatttttcacagacatcggatgaatcctatgtgtacatgactccgtccttaaacattgcatttaacaaaaacctggaaaaagaccgggagaaactggatactgcactggatgtgctggattgtatgatttcagaagaggggcaaaagctgattgcggatggaagcggtgttatttcattgaatacagatgttccaaccatgatgcaggatgtgcctggactggaagaggaaattaacaataatgctgtttatatccgatattccgctcaaaagtcatttgatgcaagccttgaggctgttcacggattactgtcaggggagatggatgaaatacaggcttatgatactttgcgcagtgtaatgaatcgtaaagatccagaagaaaaagcaacggtgaattttaaaaatgaatattccatctcactgaacgatagaaatggccgtgatgcagcatcttccattttaactacgatcagagaagaaaatgaggcacagctggctctggcgccatattattatttcacttcctctatgtacaaaggagaatgcaccagcagccgggttggcatgatgacagcgaagagttcagatacagcattatattatgcaaaaatcaatggtaaacaggtttatgaactcgtggaaaattatcttgctgatgctgatgagaatttttacgtaaccaataaatacgaattaccaattgcatccggtatgaaaatgatcgtcaatcaagcggaaagtagattttcattaaaggacttaacagttaatgataagaaaatagacaaagaaaaggaatactcgattcttcttacagacaccacaatgtctgttttgaaaaaaataaatccgaaatgtgagattgagcagcttaaagataccacattatcaagtgcatggaccaaagcaatgtcaaaaggacagcagccgtcagcaccggaagactatatagaggttgaacagtaaaagtggagatagaacaaaaggtaaacaaaagaaaaaaaataacaaggctgttacttatactacttattattcttttaagcttagtttgtataaagtatcttataagtaagtctaataagtatatcagcgaaaatggaaaaagcagtatgggagctgttattgaccagatacagcagacctatgatcttcaggtgagtggatactacagccagctgcagttggttgaggaatttttacttcatgagagggagctgtctcttgaaacggatacgaacaaaagtttctttgaagcatgggaaaaagaatcggaaagtacacttatattccttcaggaaaatggtcaggcgatatcagcatgtggaacaaaaatgcggattgatatgccaagtaaatttctgctggacttaaagaatggatacaatattggaaaactggtgtgtcttgattatgatcagaagaaaaaagacggttatctggttgcgattccatgtcaggaatacacgatcaatggggaaacttatacggcaattggaactgtgtatgatcattcgaaactggattccatgttaaaactgaaaggttatgatgggaaagcatattttttcatgctggatgatgacggaaatataacgtatacgaacctgagtggtgataaatactttcgtaattattctttgttaaaacatttaaaaggggaacaggctattacagaagaagaggctgatttgttcaaaaagaagtttgataacagagaatccggagttgcacttttgggaaaacagaatccctattatctggggtattgcccgatagaaagcaacaacaccattttggtatgcattgtggcaaagggagttgtggacaatgtgctgatagattaccagaaaacggtgctgtgtacaacaacactcatggcaggttttatacttttactttttgccggattattctacagtatttccagacttagtcttgcagatcaaaaagcagaatatgaaaaaagaaacaatgaacttcatttacagacaatgaaggaaatggaaatagtcaatcaaaaactgaaaaaggcaaagaatgttacgacagaggctttacagacagcggaaaatgcaaataaggcgaaaacggatttcctgtctaatatgtcacatgatattcgtacacctatgaatgcaatcattggtatcacatctttgatcagacatgatgcaggtaataaagcaaaagttatagagtatgcagataaaatagatatttcatcacaacatctgttaggaattatcaatgacgttctggatatgagcaagattgaggcaggaaaaacagtcttcaagtattctgacttttctattctggattttgtacaggagcttgacactatatttcattctcaaatatatgaaaagaagcagacgcttacaattataaaagaaagcatccgtcatgagtgggtgaatggggatcaggttcatttgatgcagattttcagtaatctgctgtcgaatgccataaaatatacgcaggaaggtggagaaattcagtttctagtagaagaatgtgagacaaagtcatctgtctatgcaaagtaccgctttttagtcagtgacaacggtatgggaatgtcggcagatttcaaagagacaatctttgatccgtttacccgtgcggaaagttctgtgacgaataagatccagggaaccggacttggaatggcgattaccaggaacctggttgaagcaatgggaggtaccattgatgtggagagtgaaccgggacagggaagctgttttgaggttctcatagatttgaaaattgcagagaatcgaacggttgctttggcggcacaagaagatgagcgggatggaaatattctgcaaggcatgagattcctgtgtgcagaggataatgagctgaacgcagagatcctgacggaactgttaaagattgaaggtgcggaatgtaccatctgtgaaaatggcgaagagattttgaaagcatttgaacagtctgctccaggtgattatgatatgatcctgatggacatacagatgcctgttttgaatggttatgaggcaacgaaagcaatccgcagaagttcccataaactggcaaagacgattccgatcattgccatgactgcgaatgcattctcagaggatattcagcattctctggcagccggtatgaatgcacatgtttcaaaaccggttgagatgaaggtgctggaaaagacaataagaagtataaaatccggggggggtaccgaaccgcaaggcattgaacagtgataaatggaaagtaaccagacataaaagaatcgaaaaggatagttagggatagaagaaaaatgaaaggaaaaagagtgattgcaggcattctgcttgcgggaattttagcagtcaccctggcagggtgtaaaaacacagataacacgaaagaagaaaccgaaaagcctgtcattacgcttggcagcgacaactatccaccatacaattatctgaatgaggatggtgtaccgacgggcatagatgtagaactggctacggaagcatttaaaagaatgggatatcaggtggaggttgtccagatcaactgggagaagaaaaaagaactggtggaaagcggagagattgactgtatcatgggctgtttttccatggaagggcgtcttgatgattatcgctgggcgggaccatatatagcaagccgtcaggtggttgctgtaaatgagaatagtgatatctataaactgagtgacctggagggaaagaacctggctgttcagtcaacaaccaaaccggaaggtatctttctgaaccggacggatgaaagaatcccaaaactgggcaatctgatcagcctgggacacagggagctgatctatacatttctgggaaaaggatatgtagatgcagttgcagcacacgaggaatctattgttcagtatatgaaggattatgatgtaagcttccgtattctggaagagcctctgatgatcaccggaataggtgtcgcttttgcaaaagatgatgacagaggaatctgtgagcagatgagccagacgctggaagaaatgcggcaggatggcacatccctgaaaattattgaaaaatatctggatgattcccagaagtatctggaggtggatgatcttggatattaagagaaagaaaagagaaaaacgaatccagctgatcggtggtctgattggaatctgtgtggcagcagtctctctgttttatttctttcatgcggagaaagcggaagcagagaaaagaatggtagagattgtaaattatgtcaaagtgcagtgttccacctacacccattataatgaatcttcggaatccaaaagtcttctccgtgccattgaaagtgtcagacagatgagtacgaatatcgacatggaaatagaaaacggcggtcagctaagtcaggagttcctgaaagaaaatcttcagactctctgggtggatggtatccttgtactggatgcagaaggaaagacggactgtgaatacagcacggatgagtctctggctaatgagattacagagtatctgcaaaaagatattatcatggattttaccggatatgaagaaagaagctattcggaacggtttaccagagaagacgggtcacatatcgacattgcagcctgtgccagaaaagatgcaccgggtatcattgcagtttattattatacacctccggaatttgccagaaactatactttgacgatacaggggcttttaaatggttatagtactcagaaagatggaacgattattgttgcagacgagggaatcgttgttgccagcaacgatgagagcctgttggggcagaatacggctgacaacgaagttgttcaggcaatgaaaaagcatacagacagtcagcacatttatcacttgaagaatgaaggaagcggatgttacggaatcatgctgaaacagcgggattattatatttatgcatatcttccggatacggaagtgtttcatgatcttccattaagtgtagcaggtgtcatttttctttatttcctgatgttcagtatattctggttctggacatacagaaccaagagggcacatcagaaactggaacaggaaaaagatgaaaaatataaagcagaactattaatagctgcaaaaaaggcagaagccgccaacgaggcaaaaacagagttcctccaacgtatgagccatgatatccggactccgatcaatggaatccgaggcatggtcaatatggcagaccattatgcagatgatatggagaagcagacggaatacaggacaaaggtgaaagaggcttccaatctgttgctggaactggtaaatgatgttctggatatgagtaagcttgagtcaggtgaagttgttctggaagagagtccatttaatctgagcagtattttcagggaagtatttaatgtgatcgagcagatggctgcagaacagaatatccggattgtatgggagaaaaaagaaatcatacaccgtgatcttattggaagcccgatgtatgtgaaacgtgtgatgatgaatatcctgtcgaatgcggtgaaatataacagagaaaacggacagatttatatcagctggagggaaattccatccgaacagccggaaatgacgataatggaatttgtctgccgggataccggaatcggaatgacagatgagtttcagaagcatatttttgaaccatttgcacaggagcataccggaagccgcacgaaatttacaggaacaggtctgggaatgccgattacaaagaaactggtcgagaaaatgggtggtaccgttacttttgaaagtgaaaaaggcgtagggacgacatttgtgattcgggttccatttaaaatagatctggatgcggataaacgtgaagaacagacggatgcatccgaaaaatctataaagggactgcatattcttctggcagaagataatgagctgaatatggaaatcaccgaatttgtgcttcagaatgaaggtgctgacttgacaaaatcctgggatggtcaggaagctgttgaactgttcagaaatagtgaacctggtgaatttgatgtcattcttatggacattatgatgccagtcatggatggttatgaagccgcaaagatgatcaggtctctggacagagaggatgcaaaggagataccgatcattgcaatgacagcaaatgcgttcacggaggacagaataaaagcaaaagcagcaggaatggatgaacatgttgctaagcctgttgatgtggaattactgataaaagtaattcataaattggtgggatgatgaaaaatatggataaaagacaaaaaattctgattgtagatgattcaaacttaaacagagacatattgaaggagattcttggagatacttataattatctggaagctgaaaatggaaatcaggcaatccagatgataggagaaaatattggaattgatctgatgcttttagatatcaatatgccacagatgaatggctttgaagtcttggaaataatgaaaagaagccagtgtattgctgaaactcctgtaattatgatatcttctgaagatgctgttgatactatgcgtaaggcatatgagctgggaatcacagattatatcacacgaccgtttgattctgtgattgtaaagaaaagagttcagaataccttaggcctctatatgaaccaaaagcatctgataaatgtggtttatgatcaggtttacgaaaaagaagaaaataataatatcatgatccagattatgagtaatatattgggatctcgtaatagcgagagcagagaacacattctgcatattaaaacagcaacggagatgatgctgagacagctggtaaaagtaacagatgcttatcctttgacagaggcagatattgctttgattacaactgcttcttcccttcatgatattggtaagattcgtattccgaaagaaatattgaataaaccaggcagactcactgatgaagaatttaagattatgaaaaaacatagtgagcttggcgcagctataattaaggatatggactttccacaagatcatcgactggtacataccgcatgggaaatctgcagatggcatcatgaaagatgggatggaaaaggctatccggatggcctgaaaggagaagaaataccaatctgtgcgcaggtggtatcgattgttgatgtttatgatgcacttaccagtgaaagatgttataagaaagcatttgatcatgacacagcgattcaaatgatcctggatgggcaatgcggacaatttaatcccatcctccttaagtgtttgaaagaactgagtattcagctttcaaaaatgtctggtaaagagatggatgataataaacattatcatgaaatacagagactttcgaatgaaatactcagcgataaattcttaccgaaccagatttattcacagagtcttgtcaaggtcatgcaggaaaaaatcgatttcttcaaatcgaacagtggcaagaattcgattgattacaatgcggtttcaggtcaattaactatattaaatggagaacatcagatattatgtcagagagataacccgaatttcaatttgtttaaagaatttggagtaaatgaagaagatgttcaatgtattcgtgttttattacatcagacatctgtacaaaataaagaaatatctgccacgataaaagcgacggtggaaaataacagtcagatgtatagaataaaattgcatacattgtggtcgcctttaaagaaggatggatacattggaatcattggatattttgacactgtaaaataagtatgaagattacaatcatagagtgtatggaatcaaatccatatgctctttttcttgaaataagtataaacagttaagtggggagagtaacaatatgcaattgggaaggatagattttccaaaggaagacaggtagaaggcatggtactgtgtttggtaaaaaaggagggggggggggaatagtggtataattctcttattgatagattttaataacaggaggcttataccatggaacgagtagtaaattttttaaaagaagcggaaacatattatttggcaacagtggaaggagatcaaccaagggtaaggccttttggaacagcacatatttttgaaggaaaactgtatattcaaaccggaaaggtgaaggatgtttcaaaacagattcatgcaaatccaaaggtggaaatctgtgcatttaagaatggagagtggcttcgtgtagcaggcgaacttgtagaagatgatagaagagaagcaagacagtccttgatgcttatccatctttaaagaacatgtactcagcatatgatggaaatacagaggtattctattttaagaatacgacagctacattttcagcatttacacataaaccggaagtagtgaagttctaaggataacataagatggcgaaaagtaagaagacaaaaatccataaaaagatagatggtcagcttttacagatgaacaagaagtttagtaatctcaaggtgatgaaggatattgtttccatgattcagaaaccaaaatggatgcaggaatcagagacattcctatgacacagatggtatatgatgcgttccgtaaacagagagagctgaacctgatgcttggtttacagagtaatgtggagattggtggacgcagtggattcatcttcaatacaaagcatggacgtccaatcatgccggcgggagtgaacagctttctgaaaaatattgtcaatacctataataagaaagaaagcaaactggcagaagaagagaaccgagagccggagctgatgtctcctatttcatcgcatacccttcgtcatacgggatgtgccagattgggtgagaacaatgtcaatcccaaagttatgcagtatgtgatgggtcattcagatgcacagatcacaatgaatgtctacaatcatattgcagagaagtctcatgtggagaatgagatgtctaaaatgaacctgccagaaactgtacctgctgtggtataaaccataagtcgttgtcgtaaaatgtggtaagaaaatcagacgaatatatttttccaagaatttgtcgtaaaaatgtggtcaaatcaagaaaattgagtgcgaaagcaagtgaaaaattcctgtgaagcccgtaaaatcaaggcttcacaaaatttttacaaaaaattagcactcgcctattgacagtgctaaaagtaagaactataatgtatttagaaattaggaaagggattaataaagaacctagtttcaaagttaacaccgcttgaaacaacgatgcaaaactaagtatcaagattgaaaggggtaatgacttatgatgatgcctagtctatttacagaaaatttatttgatgatttctttgatgaaatggataaagatttttttggaaagaaaaatccattatatggaaaacatggaagaaatatgatgaaaacagatgtaagggaaacagataatacctatgaagtagatattgatcttccaggctttaaaaaagaagatatcaatatcaattatgaaaatggttatttaacaatttcaacaagtaagggattggataaagatgaaaaggatgaacaaggacattatatccgacaagaaagatatgttggaaatatgtcaagaagcttctatttaggagatattccaaaagaagatatcaaagctaaatatgaaggtggcgttcttcgtttatctgttccaaaagcagatatgaaacaagtagaaaatagttctactatctatattgaataaggaatctagcgattccttatttttttaattatttaataatagttttgataagttgtatcataatttctttatcttcaggtctagaacttgcgacaaggatagtaagagtagcaagagcatcattattaattctttctttaccatttttataaagagcattgttctgatttaagaagtaaagaaaaatagttgctccaattcttttattcccatcaataaaactatgatttttaacaataaaatacagtaaagcacttgctttatcttctaaagttggatataaatcaatctctccaaaactttgataaatcgttgaaatactacttttaaaagaatcatctctttcaatagaaaataaatctcctctattttcaaacatcgtattatgtataagatttatacactcatcataacgaagaacataagtatctttttggccaacaggaacctctaaatgatgatgatcataatcatcaagaatcttaaagcctctttgataagcttttagaaattctaacatagaaatactactcggtaattgtccacctacatttctatattgatcaagcattgttgttacataatcaatatcttgaaaatgacgatcattaacagcataaccttttaaaagatattcttttaatatactattagcccattttctaaaaagaattccttgtttagatttaactctataacctacagagataataacatctaaattgtaataattaacatcgactacagcgattctgtctttcttagtacgagggtcatatctttttagttgagttgcattttttgcaacagaactcttttcgtctaattctttttcattaaaaatattagctatgtgtctagaaatagtagacttatttttgttaaaaagcttactcatttgatctaaggttaaccatactgtttcaccattagaagagacatttacatctaatacaaaatttccatctttgaactgcacaacttcatttttttcaatcaaatcaaccataaaaataccatcctttccttttgtttctttaaatgatagtagcatggtatataaaggttgtcattggacagatagtccactataaagaggtcgatttttttgacataatgatgctgatgaaaatgatatgataaaggtagaaaaagtgaaagagcaggaatttgctattattttaattaaataattatatgataaaagctaacggttttgcgttagcttttagattttatgatgcccaaagacttcattatgtatatcttccatttcataatcaatatctgtaatgcttttagcacaatctgataaacgattacgaatatcatcagaaatttctttatcatttttataacgtaaatgatgttctaatgttgcccaaaaatccatcgcaatagtacgaatttgtatttctacaggaaccattactttttcattcgctaaataaacaggaacttctacaacaagatgtaaactacgataaccattttctttaggatttttaatataatctttaatctttaataaatgaatatcatcttgtcttaaaagaagatcagacatacgataaatatctttaatataatgacaaatcacacgtataccagcaatatcttcaatatttcctttgattgatgaaacttctacaggtagatttcttcttttcattttttcaacaacactatggggagattttaaacgccattccatatgatgaataggattatgatcaaaacgatgatgaaattcatcatctaaaatttctaattttgttcttacttccttaatacctgctaaatacttttgttcaacgttgacatattcatggtaaaaatctaaatgatctttcgcaaagaaaaaatcattcatttcactttttatttctttttgcatgatacgactcataaaagttcactccttatgtttatttttattataaacgaacataatgaacttgaggtgaagtttatgaaaaaaatcattatttttcttttaattatgatgaatttaacaactgtttgtgcagtaaatgaaacaccaagatataagatcattggttcttcttatcgacaagaagatattgatgaaatgtacaaagtaaaagatcaacttcttttaaattataaaaaatgggtcaaaggtgttgatgatgtttatcaagttttagcagatcatcaagatgattttaatgcaaaatattataatggtctttatacgattgtattaggtgaaggtaaaggtaaatctttagaaggaaagttacaagtttcttattgtacatcaagtaaagaaattaaaaagaaatcttggttgattaagatgttttcttaatggtgtgtactaataattattcagtttgtacatactattataaggaaagaggtgaagtcattgttgagagaatttgatgaacaagcacaaaaggcgattgtggtagctgaaagtttatcttttgattttggtcatcaaaatgttggaagtgaacatttattgctttcgttattaaagattcatgataatcaattaaaaagattattacaaaaatatgatgtcaatgatgcagttgtagaagaagatataaaaaggttgtttggcacaaatgatgatcaacctttttatatggaatatagtcaaagtgtaaaaagaatattagagagaagtattgaatacgctaaagataaaaatcaagatcaagtgactttaaatatcttaattatttctttattaaaagaaaaagaatcagttgcttatgaaatattacaaaaatatcatgtagatgtagaagaagttgtttatttgttgcaggaaaaatctgcttttgaaacaccattggatcaaataccaacacttgtcaatattaataaaaaagtgaagactaaaaaatataaaattattggtagagaaaatgaaattgatcaagtatgtactattttatctaaaaaagaaaaaaataatgttttgattattggtgaagcgggtgtaggtaagtcagctttagtagaaaaattagcaatgatgatcaatcaaggaaaagtagtagattctttgaagaataagattatttatgaactttctttatcttcactggttgcgggtacaaagtatcgtggtgaatttgaagagaagtttaaaaagattattgataaagtaaaagacttggataatgtgattatttttattgatgaaattcataatgtcattggggctggtggagctgaaggggcaattgatgcttctaatattttaaagccttatcttgctagaaaagatatgacggttattggtgctacaactattgatgaatattataaacattttgaaaaagatcatgcaatgaatagaaggttttctattgtcactttaaaagaaaatacaaaagaggaaacattagagatattaaaaggaattaaaggttattatgaaagttatcatcaaattaaaatagataatgtacttttaaaagaattaatagaattagtagattgtcatattaaaaatagaacttatcctgataaagcgattgatatcttagatttatcatgtgttaaagctaaattttatcatgaaaaagaacttacaaagaatagaattgtagaaacaattgaaaagtatttaaatattacaattcatcatcaaatggattaccaaaaattagaaaaacaattaaacaaagatattttaggtcaagaaaaaggaattcatcagatgattgaaacatttcaacataaacaattacctatctccttttttatttatggaccaataagttgtggtaaaacattaacggctaaatccttagctaaatatctaaattatcattatttaaaattagatatgaatcaatatcaagaaagccattccctttataaacttctagaaacatatcatgaacaaccaagtcttcttttatcaactttacaaagttatccacatactgttttattattagatcatattgatcaagcatgtgaagaaattattcatttattttcacaaatctttgatgatggttattatgaagatcaagctaaaagaaagattagttttgaaaatgttgtttttataatgagtcaaacatgtacgtcacgttgttgtatgggatttaaaaagaatagacaaactaagtatttaaggcatgaattgtttgataaggttgatcaaataattgagtatcaacctttatctaaagaaataatagaaaaaattattcatttacgtgaacatatttctattgagaaaatacacaatttattaaaagaggaacatgttccgattaatctatctaaaatgatgaaacaaattaaacaaatgtcctaaataagggcatttttgtattttatttacatgattataaagaaaaagaaataggtaagaaaatagaatacatttcctctaacaactctagtttcatgatataatgacagtataataatcatgaaaataatggaggaagaaaagatgactattaaattacctaaagatttcttttttggtgctgctatgtcaggaccacaaacagaaggagcttggaatgtaggaggaagattacgttcttattgggatatgtattctgatcaagaaattaatgctttctttaataatgtgggatcatatgttggaaatgatatgtaccataaatatgaagaagatattaaattattaaaaagtttaaactttaaatcatttagaacttctatgcaatggactcgtttattagatcaagatggtaaattaaatccagaaggtgctgcttggtatcataaattaattgattgtgcaaatgaaaatggtattgatatttttatgaatatgtatcactttgatatgcctgaatatttagttaaacgtggtggatggcaaaatagagaagttgttgaagcttatgcgaactttgtaaagattgcaatggaagaatttggagataaagtaaaatattggtttactttcaatgaacctattgtagaaccagaacaacaattcttacatggtgtttggtatccatatcaaaaagatttcaaacaatcaatcaatgtacaatataatattactttagcgcattgtttagctgtcgcaaactttagaaaattaaaagcagaaggaaaactttgtgaaggtgcaaaaatcggtatgatcaactgttttgctccaccttatacaaaagaaaatccaactcctgaagatttagaagccgtacgtatgacagatggattacacaacagatggtggttagatgtcgttgctcatggacatttaccacaagatgttttagatacagtagaaaatgattggaaagtagaaatcaatcgtcgtcctggagatgaagctattttagctcaaggtaaagtagattggttaggatttaactattatcaaccaacacgtgttcaagcaccagatagtaaatttgatgaaaatggtttaccatgtatttctaaaccttatatttggcctgaaagaaaaatgaatgtttatcgtggatgggaaatttatccaaagggaatttatgactttggtatgaaaataaaaaaagaatgtcctgatttacctttctttatttctgaaaatggaatgggtgttgaaggtgaagaaaaatatatggatgaaaatggaactgttcaagacgattatcgtattgaatttgttagagatcatttagaatggattgcaaaagcaattgaagatggagctaattgtttagggtatcattattggggtgttattgataactggtcatggtgtaatgcttttaaaaacagatatggatttgttcgtgtatgtttagatgatggttataaacgtaaagaaaagaaatcagcttcatggattagagaagttgctagaacaaacgaatttgaatagtcataaggtgtctaccaagggtaggcacttttattttggaaaattgaaatttttttagtatatgaaaaaaatgcatttatgggtataaatgcattaaaataaggatggtgatgatatgaatctatttataaatttaaaagaaaacaaagaactatcaaaaaatgaaagaatcttggcagattatatcttaaaacatccagaagatgttttaaaaatgtcatctaaagatttaggaaaagaatgttttgtttcaacagcaacagtctatcgtttatgtgataaattaggactatcaggattttctgacttaaaaataaaaataacaagttctcttgatgactatagaaaaagtaatgaagattttaattttgattttcctgttaatcaatttcaaacacattatgaaattattcaaaaaatcaaagaagattatgaacaaacccttaatctaacagctaatctttttagtctagaccaattacgtcttattgcttcagcaatggaaaaagcacaaatcatagatgtgtatacttctgcaggaaatattaattttgctttaaattttcaatttcaaatgcaggaaataggtatccaagtaaatgttcctgttgatgaataccaacaaagacttatagctgcaagtagtaatgaaaatcatctagcaatcattattacttttggaggaagaggtatattatctgatattttacctcgtatattgcataaggtaaaaacaccaatcgttttaatttcatcgtatgactatacatttaaagattttgatgcggattatcaactctatatatcaccttatgaaaatcattataaaaagatttcatctttttcaacacgactttctattctttatattttagatgttttatatacatgttattttaaattagattatcaagagaatattgaaaagaaattagcttattataataatattgtagaagggactattaaataaatttcaataaatgataattttgttatcaattcaacaaaaaaacaatgagttttctatatacaaaatcactaaattttgaaaaaacagtgaaaaataatgagaaaataattctaatttataattaagagaaaaaagaatttgagaaaaaaattctttttttgtactctaattgtttcaattgaaaagattatttatgatttcagtaggaggtgtttttatgaacgtaaaagcaattatgtgtgatatagatggaacactactttcaagtgaaggtgttgttacaaagaagacggttgaaatgataaaaaaagctagagaaaaaggaaccctttttggtttatcaacaggtagagatgttaatagtattcaaacattacttggtacttggggtattgaaggcttggtagatatgattgttggtactggtggagcagaaatatatgattatacgcttgatatttctaaagctcaatatccattagatggggagttgattaaagaaattgtaaagcattatgaagatatggattgtaattttgcgattcctgaagatggtattttttattcaccaaaggatgatgaatatattcaagatctttctaaaggggatagagttccttataaggttgttgattataatgaatatttaacgtcacctaaagctaagcttattattatttgtaaacctgaatatatggatcaaatcattgaaagatctaaaacatttcatagtgatgattataaatcatcatcacttaaaacagcgagtgtattgtacgaatacatggatccaagaatatcaaaaactgcaggacttaaagaaatattaaaattacatcatattgatattaaagatattgttacatttggagatgcagataacgactatgatatgacattaaatgctggtattggtgtcgttatggctaatggtagtgaaaaaacaaagagtgtagctgattatattaccgatgataatgatcatgatggaataggaaattatattgaaaaatatattctttaagagtaaaaagaattaaaatctattatcaaagaaaatatgaataattagtattgttttacaactgatgctgttgattgagatatttgtttattttgtattgatttgtttttagaagtttttgcataagcaaaagctttttctatttgacattttttctttaacagagatatcatagatatgttaggtagaggataaaagaatggaaatagagttaattcaagatggtaaagccgttgattataataaatatcaagaagtaatagagaatgttaaagaatcactttttagaagaaataaggataaagaaacaaaagaatggatgtatataagtaattttgtaggcattcttttagataaagatagattaattttatctttaccaaaatcggttattattaaagaggatgttgataaagaaatattactctataaatatgcaagattatttgatttatattttgtagttaatgaaaaaaagtgtgatttgataaataagtatgaatctattgaaaattggtgcaagaaaactatagaagaaaataaaacaagttctagttgtcaagaaatcattacttttaaatttgaaatggtttttgaatggatgataggagaattttttcaaaatcaaataagtattcaaaaaggtgatgttctctttaatagtcaattattagataaagaaatagatattaatgatacaaaatataatacttatcattggaatgcaataggaaaacagacaaaagatcataaacaaaaacaaattgtcaaagaaagagaaagtgtttttatcaatcaaaataaaaagaatatcccagatattgtttgtgaaagaatcctagaaaatcctaaatatgaaagaccacaaaagagttgttgtatacttgatgcgaaatattatggatgggattatgaaaaagaagcttactatttaccaagaaacctagatatttataaacaatttttctatcaggaacaatttcagcgtatttatgaaaaggaaaatgagacgaatgtaggtgtttataattttcttgtgttacctgattatttaggagataccaaagatacgaaatgggaaattataagacaatgtgctgttattgaatttgattatcatcaaagtcaaaagattgctgttttacaagtagatattgagaaacttgtggattttatttatagtggattagatatgaaagaagatgtactttctgtctttttaggtaatagtcgtgttgtaccaatgatttatggtaatgaaaaagtctaactttaagctagactttttatttccataatttttctggataaattcctttttcaataagttctttaatagaatcttgaactgcttgcttatcttctggataagtaaccccaaaccatttatcagttgtttctaatacttttactgaagctctgtttgttttaattaattgatcaacaataataggtaataaatattctttagtaagaggatctccactatcatctaataagaattctttaaacccattttcaagataatcaataaaacaaggataaccagcccacatattcatagaaacacggttattttcttgaataatatctttgctttcttctgtatcacaatcaattgttccttgattatttctaataatccctttagtttcaataactctatgtaaataaccatcttcatcttctacacaaataccacgagtaactgttccattatcacttaaagtattttttaagataaaaccagccatggccatggtaaactcactatttctatgactatcttcaattaaaaaatcatgaagctttttaaaagcaacttttccataataatcatcagcattgataatgacaaatggttcattaacgattcctttacaagataaaatagcttgtccagttccccaaggtttgattctaccttcgggtactgtacacccttcaggaatattattaatttcttggaaaacatattcaacttgaatgtgtttttcaatacgattaccaataacttctttaaattctttttcgatgtcttttctaataataaaaacgactttattaaaaccagcttcaagagcatcataaatggaataatccataatgatttcgtcatgaggaccgattttcgctagttgtttaattccttttccatagcgtgaaccaattccagccgccataataataagtgttgtattcataaaattctcctttttctaagttagattatatcatatttctagaaatatctatgtaaattttattattttatcacggtgtgataaaataatcatgaggtgaaaaacatgaactatagtttaattcttttatgtgctggaagtggcaaaagaacaggtttgaaatataataaaattttttataaaataaacaatcaaactgtttatgaaatgaatatttctcattttttagaggataatagatgtaaacaaattattgttgtaacgaaagaaaatgaaatagatgatataagaacattagttaatgattcaagaattgagtatgtttttggtggtaaagaaagacaagatagtgtttatgaaggtttacaaaaagtaaaagaaaatcatgtctttattcatgatggagcaagaccttatgtaagtaaacaaagtattaatgatttagttgaatgtttaaaaacatatgatgctgggttattaatggttccttgtaaagatactattaaagaagtgaaagagggtattgttgttaaaactttaaaaagagaaactttgatgcaggctcaaacaccacaagtatttaaaagtgaagatattaaggtggcttatcaaaaggcaaaagatgaaggatatgttgcgactgatgatagtcaattatttgaaagatatatagataaggatattaaggcagtattaggagattatagtaatttaaaaattacaacacgggaagatttaaaatgaaaggtaagcatattagaaaagagaaaaagagtatagtttggattttaattactttatttgttttaataggagttatttttggatattttcattttaaatctgatgatcaagaaaatttaagtcaatataaaataattgtaggaacaattaaaaatgtgggtgatgaaacattattgatagaaacaaatgatcatcaaaagtatttaatttctattgcgggagcaatagattctaataaaggtcttatcaaaggaaatagaatatatatttactatgaaggaacattagatataaaaaataaagatatccaaagtataaaagtaaaatcatataaagtattggagtaataaacctagaacaatacctattaaagaaggtattgtttcttttttattttcaatatttatattttctttttcatctactaacatccatatagaaacaaaaaacaaatctacccacatatcaagatgttcaaaagtcttacccacaataaaagtaaaaaatgtatataaaatagtttttaaatacttttttaaatattctttaaataagggagaatatttaaaaagtttattaagatatttttgaataaaagaaaaatcatttttgattaaataatgaaataaaatcataaaaaatatccaaaataaaaataatagataattcataatatcacctcaatatagaatatgaaaaaaacatgcctataaaggggtaaaattacataaaataatcattttattattgcataaaagtaaacaataagatataatggacgagcatgtaaagattattttactgcctgcttactaaaaagtaagccaaaagaccataggaggtaaaagagatgaataaatatgaaattatgtttattgtaaaaccagatgttgaagaagaagctagaaatactttaattgaaaacttcaaatcaatcttaactgctaacggtggttcagttgataatgtcaacgaatggggattacgtgatttcgcttatgaaattaaagattacacaaaaggttactatgttgtagtagatgtaacttgtgcaccagctgaaatcgctgaattcgaacgtttatcaagaatcaacgcttcagttttacgtcacttaactcttcgtaaataattaggaggcatttgacgatgattaatagagttgttatggttggtagaatgactcgtgatccagaacttagaagaactggaaacggggctgcagttacaagttttacgttagcgttaaatcgtaactataattctgcagatgggcaacaagctgattatatttcatgcgttgtatggaataaagtcgctgaaaatgttgcacaatattgtgcaaaaggatctttagtaggagttgaaggtagacttcgttctagatcttatgataatgctcaaggacaacgcgtatacgttacagaagttgtttgtgactctgttcaattcttagaaacaagagctcaaagagaaagaaaccaaagttctatgaaccaaggtatgatgaataatcaatattctcaacctgctcaaccacaaacagataatttccaagatatgcaaacagttgaattagaaaaagattttgataattcatttaatatcatggaagacgatattcaattttagaaaaggagtataagaacatggcttttaaaagacaaagaatgggtagaagaaaagtttgttattttacaaaaaacaaaattacttacatcgattataaagatgttgatttattaaaaagatttgtttcggctaacggtaaaatcattcctagacgtgtaactggaacttctgctaaatatcaaagacaattagcagtagctatcaaacgtgctagacaaatgggattattaccatacgttggtgaataataactattaaaaaaccttgatgaattcaaggcttttttgttttttaagaacatattgacatcaatttgacatcatttgtataaattattgagtttttctgatagtgattctttactttcggcgtataaatggctatatgtttttaaaacagtatctaccgtatcaccaattctatcggctacaatggttggactatagcctaaatctataagtaatgaaacatgactatgccgaaaagaatgtaaagtaaattcttcgtttaggttagctcttttttgggctttttttaatctatctctaattattacataatattctttgaaaattctatcatcttcgttgagaatataatgcttttttagatattcttctaattgatcacataaaaattgtggtatatcaacttttcgaaaactgttttcggttttaggaggaccaatagtgtcttttgctttaatgcgttgatatgatttatcaatattaatgattccattttttgaatctatatctttgacagttagtgcaaatagttctccttttctcatccctgtaaaataaagaatagtaaaaatgatttttactgtttcatcctgacaattttctattagtttatcaaattcttcttttgtataaataactttttctttacttttgtgttttcctatactatcaactgaattacaaggattattttttagagaatagtatttttcagcgtagttaaaaatggcaatgagttgtgcattgattttcttttgataggcaagagaaaaattcatcttaagtatttcgttttgccataaacgaatgtcaatagcacctattttattcatttttttattttcaaaatatgggagtatatgtttttttatgatgtattctttgacgagaatagttttaggcttaagacgtgttgacatatcctcgttgtataaaactaaaaattgagaaaatttcatttcgagtgattgttgttgtgtggctaaaaaatctctttcaaactctttagcttccttttttgttttaaatcctctttttcttttttgctttttattaccgttactatcggtatatctaaattgacaaaaccatgttttggtcttttcgtcataatacgttggcattgttattcactccttttcgtggtaaaattggagcatgaaaaatgattgctgtggtaggtaattctttttcatgctttacactctagttggcgctagggtgtttttttattatgtaatcttatacttatttttgaaatagtaagccaaagcaactttgtacataccatcaatagattcttcagtttcgaattcgaaattaaaatcattattaggaaaaagaattttattaataatttgttttttataatcaggatttctttccttaaactcgttgatacattcttcgttcatatattgtgactcatagatggttttttcatattgaaatctagtatctatgtcagttctttcaagtatatctaaaatatcccaacgaatatacttgagcttttcgtgatcaacttcaacaaaagttttagcacgtagttcaataagtgcattataaaaattatcaaacatgtcatgaaccttccaactttgtctatataactccttacgatgattatcgaatgtgtctttcatatactcaaattttccagaatcataaagcatgatgcactctatttctgagtgatcaattggatgaaaatttcgttcatataatggatccctattttctaagtcaaagaatacagatggattgattcctaattcttcagatatttgtttgataacatcaattttaggttcacgaccattttcgtaattttgataagtggtatagggtatgttaagttttcttgctaattcagccttactataacctttattctctctttcgcgtttaagtatttcagaaaacgtactcatatttcctcctttcattacacattataggtaaatttagggtttatgtaaatatgatttacctaaaataagtaataaattactcaaaataaataaaaatatgttgaatattaacctaaatatggtaatatttgagtgtaaggtgacttgaaataggttgtttacataagagatggaggtggaaaaagatgtatattagttcagttaaaataaagattattctagcaaaacaacaaatgagtttaagacagttttgcaaaataaacaacctagcttacagtacagtaataggcttaatgaacaaagagagaataggtaatttacgtacagtagaaaaaattgcacaagctttaggtgtaaaaatttatgaaatattggaggagaaataattatggaaaataaaagtgcgtatgtaaatgctcatgaagtatctcagttattgggagtaagccaaagtaaagcgtatcaaatcataaaaaagatgaatgatgatttgagagaagatggttatcttacaatagctggaaaagtttccagagcatactttaatgagaaatggtatggtgcaagtaatgagtgaattaaaaaataatgcattaaattatgcaaaaaaaggatttaagatttttcctttaaagccaaatacaaaaggagaacaagtgttagaatcgtggaaatacgagtctactacgaatttgaatcaaatagattattggtggaataaaaatccaaactataacattggtttagttactggtaatggtttgttggtaattgatattgatgttaaaaatggaaaagatggattacaaagcataaaaaaacatggaaaaggattacctaccacagcaattattaaaactccttcgggaggatatcatctttattaccatgttaataagacaatcagtaatcgtgttaatctttatgatggcatagatataagaggagatggtggctacgttttaggaataggtagtaaaacagataaaggaatatatatgctttataaagatgttcctattgcaaatgcaaatgagaaagtttatgagtttattgaacaacaaaataaaaaagaaaagtatgtagagaactcacaacaagttaatgaaggtggaagaaatgattatttatttcgaattgggtgttatcttcaacaaaaaggattgagtaataggactattcaaaaaagtctggaaattgaaaatgaagaaaaatgtaacccaccactagaaacaaaagaagtgatgcaaattattgaaagtgtttttcgatatcataaaggatatattgaaataaagaatagtaaaaactatgaaggaacatatactgtaactgagttattggaatcaaaagatcaagaagaattggatattgtagaaaatatgatttcaattggtcttactttatttggcgcacctcagaaaatgggaaaaacatttttttgtttacagttatgtgatgcagtttcaaatggaaaagagtttcttggaaaaaaagttcaaaaaggaacagctctttatttagtgtttgaagataagaaattaaatattaaaaaaagacttcaaacgatgcaaattgaaaaacaaaatcaatttattatcgacatattaaaaccaaatgtacattatgacgttgaagaacgtatcaaaagagaactgactattcatagtaatttaaaaattgttgttattgatacctttgcaaaaataagaaattcaaaagatagagattatgaaagtgaatatgaggaagcaacattctttcatgagttagcttataaatatcatatagcgattattctagtaacacatgttagaaaagaaatagatatcaaccatccatttgatgcgatttatggaagcagaggtttgactgctggatcagatagcattctcgtaatgtttaagaaaaatcatttatcaaaaaatagacaacttgctattcaaggaaaagatattccagatgatgagattactttatatatgaatgattttcaagttttagaattgggagaaaatgattttgatgacgatgtagatgaaaatttagttaaagtaataaattatattgtcaaagaaaaaacgtttataggaactcatgaagaattgtgttctaaattacaacttccaattcttcatagaaaactacaatctattttaagtaagaatgtagatttgttagaaaagacatacattacttatgaaagattacagagaaagaagaatgctcgtcttattaaattaacttatcaagaggatgatagcttatagaaaggtgacggtatgacgtttaaagggaataaattgataatcgtcacaccgtcacacaatatttaatttaagaagataaattatttaagatttttgtatcagcaagcaacgtattttgtgcccaaaatacaatcacaagttggcagcgccaactaagaaagaaggtcgaatatgaaaagaaatcatgaaattaaagttagattgaatgatgatgaatttaatgatttgaatggaaaagttattaaaagtaaacttagccgagaagaatatatcagacgttgtttttcaaaatcattgattaaagaacctcctgatcttgattactttcgtttaaaaaatgaattcaatcatatagggaataatctcaatcagattgcaaaatcattaaatacttatgaacaagttgatatacattttatagagataactgttaatgaattaagaaacatgattaagaatttagaacaagaagtaagaggtgtttaaggcagttacttcaatttggtgtgttaaagatcgacttgatcacgttgttcattatgtagaagatgaagaaaaaacagtggatgcagttatagattatgtgaacaatgataataaaacaaatgagaaaaagtacgttacttgtatcaattgtgattcatttgatccatgcaaatcaatgatgaatacaaagaagttctttaatgatcataaacagatcatggcatttcatgggtatcaatcatttgaacctggagaggtaagtagtgaagttgcacatgaaataggtgttaaacttgttgaagaattatatggtaatcgctttgaagttgttgtcgcaacacatgtagataagaaccatattcacaatcattttcttttaaattcaacttcatttgtggatggaaaaagattttgtaataccaaaaaagattatcaaatgttaagagaaacatctgataagttatgtttagaatatggtctatctgttataaaaaatccaaaaaaatatacaaagaaagtaaatcaatatatcttaaaatcgtttatgaatgaaataaaaagagatattgatgcaacagttttagaatgtgcaagatatgtagaatttaatgcagttatgcacaataaaggttattcattcggtgaaataaatgatgaaccagttatttatcatccttattgtgaagaaccgatttatataaaatcacttggtaatcaatatcatagagaacaaataaaagaacgattaacaacaaaagtcattccatttcaaaatatggaacaaaacaaatattactaccaatgcaaagattattatcgacaatatagacaaaagaaacttccacaacttgctggaatgtatgtagcacgtttagtttatttgaatatacttcctcaagtaaaacaaaaattatctaaggaaacaagacgtgaattaaagaaattagatcaatataccaatgatattgaattactagcaaaaaataagatagaagatattactcagttagattcttatcaagaaaacaaacaagatgaactagactatctcattaaacaaagacaacaatgttactactacagacgaaactcaaaagatgaagatgaaaaagaaatgtggtcaactaaggctaaagaatttacaccacaaattaaaagcttaagatttgaaatcaaatcatgtaagcgaataagagaaagaagtattcaaaaagatatagaaaaattagcgatgaagaaaataaaacaaagagaaagcagggatgaaagatgaaagaaatagaatatattcgttgccttatatctccacagctaaagctgggagctttacggcaacatttggtaattcttttttggggtatttctttaataacttctaattctaaaactatcatatcttgtctctccgtaaaatatagtatatcatatttttaggtgatgatatgattttaacagaagaaatagaaaactctttaaaaaacgaagcagatattatacgaaaatcaggattagaaagaacatatgcttataaaattattcgtggtgaaaaaggaaaaaatgcaaaggataaaatctatcgcttagcgcttgctatgaatttaacccaaaaagaaacaaatcatttattatctttaaataatgcaggtgacttatatccacataatgctagagatcttattttattaaatggcttgttaaaaaaacaaaccgtagaagaagtcaacattgaactttataatcatgatttagagcctctaaaagactaacaggacttctaaggaagtcctatttttcttcattataacaatctaatatatatttttcattttctacccataaatcattttctaaattagatatctctaaaatcactatattttcaatgatttcaaataaatcatatattattttttatccgtcgaaaagtatcagacatcttatttctaacttatttcattcaacttatagacgaccgtttccccatcaattttatttatttttatttctatacaatcgtgattttttgcaatatctatattcttctttgttaaaggttttcccctattatcaatatctatatcaattgtattcatcctattacttaaacttatttttaaatgattctttttaaaaaatacaggttcccctctttcatataataaaatagaatctttatcatttatcttttcttttaaaataagatgcttttgtttatcaaattgatgaaatatcgaaaaatacgacccattataaatacgtgtaaaaatcatcatagaaataatacataatagcatagccgtttctacaataaaaataaataacttcattttatatttcatagattcaccttctattttatagccttaattgttatagttggatgattgcgtatataaattgacggaatatgattttgccatttaacatttacatcctgctcattattaaagtctaaattttcattagagtaacacctcgtagtataactatatttttctaatttattaaaaataacatcaactcgaatatccacgtcaaacaatgataaatgctctactttgtatatttttactattacatttgaaagagaatctttgttttcataaagcaaagtctcttcttggtcatcatgaattattaaattccaaatagtattattagaaaaataattttttgttattaaaaataatactattaatagaattattgtttctaaaatgataaattttgtaagaatttttttcatattttttcctttcttaaaaaacgaatgaaacttcatttgaaatttcattcatttaagttaattatttgctttagaaaaatatgaatctaaaggtgttttggtatgctcaacaacataaccacttccgcctcgacctttaacatcttctacaactgttgtcattaaaattggtcgctttgaatctgttgtcatgactgtaaaccagcctagttcacttcctgttgtatcactttgactttgtttgatttctgccgttcctgttttcccagcaagttggatattttcatggtaaattgaatgccccgttccattttcatctgctataacattaatcaaatcttctttgattgtttttactgtttgatcactgaaaaccctttgtatccacatttgttctcctttttttacaatatgtggtcgatagattgaaccattattaatgaaggaactgtagatacttgcaagttgaacaggattcataagaatttgtccttgtccataaccactatcggcaataagttgatcatttactttttgttttttattgatatattggcttctatttaaagaaagttcaaaaggaatcttttcgccaatccttaagtttttatagtatttaaataaattttcttttccaatatttaaggcgcttcttgcaaaatagacattatctgaataggtcaaagcattttttaaattattaggtgttggtgcatgtaatgttgttacataataattaccccaactagaatctttttgccatttgtcttcagcccctaaatctttatctaaatcaattgattttgtttctaatccaatagctgctgtgattggtttcattgtcgatcctggtgtataagtttgtttataacgattcaataaaggctgattgacatcgttatttaattcattccacttatctattgataatcctaaaacaaagtcattatttgaataggatggtgttgatacaagtgctaaaacttctcctgtttttggattgagagcaacagaagcacttttatcattttgatattcatgttgccttatatctccacagctaaagctgggagctttacggcaacatttggtaatgctcattcttttatggtaatacagcaaattaaatgctttctaacataaatagcctaaagataaaacatatttataacatttattcactttcatctgcctttctttgacagctattattatacgaataaatatttttatttatgaaaagagcacaaaaaacttaaaaaatattcttatataaaaataataaaaaagatgccaaagcacctttcttattaataattttctgcatgaacttcaaagtacgcttgtggatgatcacatactggacaaacatcaggtgctttttccccaacaacgatatgtccacagttacgacattcccaaacctttacttcacttttagcgaaaacttcttgcatttctacattatgcaataatgctctataacgttcttcatgatgtttttcgatttctccaaccatacggaatttagctgcaagttctggaaaaccttcttcttctgcagtttttgcaaagccttcatacatatctgtccattcgtagttttcaccttcagctgctgctactaggttttcagctgtatttccaataccatttaattctttaaaccacattttagcatgttctttttcattatctgctgtttttaagaataaagatgaaatttgttcaaaaccttctttttttgcttttgaagcgaagtaagtatatttatttcttgcttgtgattctcctgaaaaagcttccattaagttcttttctgtttgtgttcctgcatatttattagccatgtgtatttcctccttttattcctttttaggaataattcctatttatattttaatctttgttctttcttttgtcaattaaaaaaggagaaagagaatttctcctcctatcactaacatgattgcaatagaaaatgaactcatatatggagagggattagtgatagacacatttctatgtgccttttaatcatactctcttttagaatcagctttttattttagaacaaattggtcttatttgtatcttcttattatactatctcttggattatctaaatgatattctttagcccactttctaaaatgtcgattaatatattgattaagttgaaccatatctcgtttattaagatagatgtcaaccaatccaagaggatcttctaatggataagctttaattctttccatcatttgataaacaacttcattgttcataatttgaaaagaataagtatcatattgtgtaataacatctaaatccacataataattcatatgtacttccatgaatttcatatatccaattgaactggacattgatagtttaaagcatttgacatcactgtattttatttctgtctgaaaatattgaagaaaatctttataaaaatataaacgatcataaatcgttccataatctaaaacattatctactgctattttaactttttttcttttaatataattattaattttttcatctatatgatctaaatcaagttgtcgttgttttatcaaatcttttttattttccatagcatctctaattgatttctttttattaataatctgtttgatttcttctatagcgacgtccatctctcttaataggagaataaacttaatttttgaaacatcattttgattataacatcgataattattgttatctcttaatggtttcactaaaccttcattttcataataaatcaacgttttctttgtaatatctaacatttcttctacttcatgtgttgtcatagctatcacctctacttatattaaacagtatgaccttaggatatagtcaagtaatttattaatttaaaatgaaaatagtagatgtgctctactattctaataattctaaaactcttttttgaataatttcttccaactggaatataagatatgttttcatttgtgaaaagtaaacatgttgaacaaagctttcctttccatttagaaagcccataatccacataatgtaaacccattgttttagcaatctgtgaagcataatattcactataaggttctaaaccactgtttgcaaatccttctgttcctgattaataaagaaaaatattattttttattctcctctatgatttagcaagcatcccatttgttgtaaattcaggtgatgatctaaatgaagttctagtataacttccatatcctgtaaaagcaatagaagcaatgttggtattaaaagaattatgataaagatttttatctttaaataagtctttacaattttcttgtacaacccaataattatcattcaatgataagccttgacatatatcaataataccttttgtatctttctcatttaatcctaatcgtgataaaaaattagaagcataggctctatttctaggaattgtccttttttgaagccattttttaatccttcattacttaattctaaatctaatggtaaaagatcgtgtaaattttgattaacagcatcaataaaaatttctaatccattatttgtatttttctaataaaaaaatacgagacaattttgtctcgtattatcttaaatttttaaagctgttgtatatgcgccccaaatagcagtcattaagttacctggttgaatagcatctcctaataaatagacattttctcctttaattgaatcatataatgtttgattagatttataaccaacagatacagcaactgtatcagcttcaattgcttttggtgtatgatgtaccccaaataatgacatcatacgtgctctattattaatatttggttcgtttgttgtcatcacatcaatcatcaatttaccatctttatattcttttactgttgcatttttataaagatcaacatggtaatattccattaattcaacaagcatattatagtttggagctgcaagaccttctacattcataatggtaggtaaagcttcaacaactgaaacttttttattctttctagcaaggtcataagctaattcacaacctgtaagacctccacctatgatgacaacattttgatctttaatatcttgtttatctaaaacatcaactgcatatcttacatttggttgatcaaatccaggaatattatctaaacgtttttcacttgctccagtagctacaaaaacaacatcataatttgctttatcttctactttaaattcagtattaaatttaacattaactcctgcatctttgatttgttttttataccaagctaataaacgacgatcatcatctttaaaatcaaaagcacttgcttcattaaagacaccacctaaacgatcagttttttcatacaagtcaacactatgtcctcgaagagcagccacgcgtgcagcttccataccagcgataccaccaccgacaacagcgactttctttattacatctgctttagtaatattataatgattttccattccacaacgtggatttaaagcacatgaaatatctttagaagacattgttttcatatcaacttggaaaatacgtgctaaacatccaaagtgacaagaaatacatggtctaatatcatcttctcttccttctttaaacttattagctaaatcaggatctgcaagtaacggacgacccatacccatcatatcaatcttaccagccgcaatttctttttcagcaagttcaggattatcaaaacgaccaccacaaataacaggaatattaacccattgttttaccttttcaacatcttccaagttacatgcttttggcatatatactggtggatgtggccaataccaagcatcataagaaccattatcacaatcaagcatatcataacctgcttcttctaacatcttagctactttttcactttcttcataatctctaccaaattcttgatattcttctccaggtaaagcacctctgttaaaatcttttgttttacttacaacagaatatcttacagaaactgggaaatcttccccacaagcttttttaatagcttttacaatttcacatgggaatcttaaacgattttctaaacttccaccatattcatcattacgtttattccatgctgcaattgtaaattgatctaataaataaccttcgtgtacagcatgaatttcaactccatcaatccctgcatctttagcagcttttgctccttgagcaaaccattcaatatattgatgaatatcttcaatactcatttctggattatttttagatggatcccatacattaggcattgaactaggtgctggatctgtaggatgaatagaagctctaccagacatagcagttaacatgacaaatacttttgaaccgtatttatgcacaccatctgctaaatatttcatattttcagtgtagcttttaacatcattaacaatactaggaagtcctgctccttttggcacaggaactaaaccagtaataattaaaccagttcctccttttgctctttcaatataataatctgccccatcttttgtataacttccatcattattcatcatacgtgatgaaaagacacccattggaagtaatgcaatacgattaggtacttctactgtaccgattttaatcggtgaaaacaaatgttgatatttattcataccaaatccctccttgaattagttcactgaatttattcagttaacttatatatacatcgtaacccttaataaattacttgtcaataacttaataattttttcacatataaataaaaaaatagaaagactttcgtcttcctataaaccaatataatctaatacaatagaaatctcttcatgaacagcttcaactaaatcataacttccattatgacaacaccaatcataaatactacctctactaattcttaacatcattttagcagcatgttctttattcatatgttgtatattatttaagttttctaaaagtttttgataaagatatctttcatcacaatataaatatgcattttcagcatttatttgatttttaaaacaaatagttgtcatctttaaaccaatatctaaaaaaacatctttaatttgaaaatctattaaaaataaaatagcctctctttcactattaaaagtttgcttttcgtaagcttcttttaacatctgatcaaattcataatatccataatcaatgatggcttctttatttttataatgataatagacagatcctacagaaacatttgctgccttagcaatatcacttacttttaccttatcatatccaaattcatcaaataacttaaaagcaacatcatatattctctttttcgtttcttctctttgtatatctctagtagtcatcctattcctcatttctaaacagaatagattttatcaaaagttatagaaaattacaaataagttacatatttccagattctaatgctttaaaaaaatcatgtgcttcatcatggatatttactttctttgttgcctcaagaacataccacgtaaattctaaatcttgaataataataggaattctcttaccacatctttgtagaaaataatcttcttcaattaatcttctagcaacatcactaatcacttctaataattcataataccctactggaccttttcctatatatctacaattttcatcataacaatcaggatcttcataaccaatattctctataccttcttgtttataccacgcaaataaagtttccattcctttttcatcaagcatatctttatcatcttgctctaaatatgcataattccatctttcttcactataaagaccttcatcatctccagaatattcacttttaaagaaagtttcattatttaaagaaatactaaattcacaaacattagaatattctttatatgtatatgcttcattactatatagaaaaaaggtaatagaataagcatctgacatatcccaatgatccatttcattttttatcttattataaaaatattctcttaaatcaatcatcactctaatcctttctttgtttatttatttaattatacttgataatcaaagtgattaaaataaaaaaatcctcctcgttgatttcaacgaagaggacattttaattaatcatttctttttcttcttgctaatacaaatacacatcctgaaataaacatcattactgcaaatgctgtaattgctgtattatctcctgtttttacttttgatttttgtgtatttttctttgtttctgttttaactgtttcgtcttttttatttgttgattcatcttttttatcagatggatttgttggttcttcttttttgttttctgttaatgcttcatatgctttatttaatgttgctaatgcttcatcaatatcttcttgtgaacttactttacttaatacttctttagcatcacttaatgcaatttcaaatactgaccatgatgcatcagtatagtttcctttttcaagtttttctaattctgctactttatttgctaattcatctctattaattgttttagcatcgtatgttattccataaccattaccatataaaatttcatcagagaatgaacctgtttcagttccattatcagctgttgaaagaacatatttaggaatacttactggtaattttcctgatgatccaaagacaccgaatgcaacttcaacaccagctgtaatatttggcccagaagctgaagtagatcctgttgctccaccgattaattgttctgttggatctccttttgatccataaacagccataattgcatcagcatttggatacatttgtacatcataaggtttgttagcagaaataactactgttgttttattagaatctgatttttcaacgtaatctactaagttataaggtgttccagtataattattttcataatgcgcttttttcacatttaatccactattatctgaaacaacaacaagtgtatcacaccaatctagtaaatctgtcattgctgatgtatatgttgaaccatcagcattaataactgttgcatcagaggcaagtgtacgatccatatatcttgtaacttttacttcagctccatctggaattaatccagcttttttagcacgttctacaccatatttcattaatgatctttggttattttcagctgctactaataatactttactttttttagtaacatttaatggtaatgtattattttcatttttaacaactgttaccgctttagcagcgatttctctttctttagctctgttttcatcacaacctactgttgctaaagctttttctaatgaatagttagattctttccaatctaaaattcctttattttcttttaatgttaagattcttgttacagcatcgtctaatctagattcttgaatttcaccatcatttactgctttttctacaccatcgataatggcatctaatttagacatatcttctaaacaagtaatatttgttggcatacaaattaaatctacccctgcattaatagcaagtttaacagcttgtacttcatcataagttgctgcaatacctgccatgttcattgcatcagtaactacaacaccattaaatcccatttctccttttaataaatcagttaagattttatgagataatgttgaaggtaatttttcttctttaccagttttatctgaatgaactgttgtatcatctaattgtgggtaaagaatatgagctgacatgatcatttcaataccttgattaattgctacttgatatggttttaattcattattcaataattcttcttttgatttattaaccattggtaatccataatgtgagtctgttgcagtatctccatgaccagggaaatgttttgcacatccaataacattatattcagctaatccttcaatttcagctgatgccatttttccaaccatttcagcatcttcaccataagatcgtaatccaataaccggattattagcattattatttacatcaacaactggtgctaatgttgtattaatacctaaagaacttaattcactaccaataatttctccagcgattttagcattattgacgtcacctgttgctcctaatgccatattacctggtaaagcagttcctgatcctaaacgataaacaattccaccttcttgatcagttgtaatcaataatggaataccattatcttttgttgctgctttttgtaaatccattgttaaattgaagctttgttcagtttctttaatattattagcaaagaaaataactgatccaaaatcataatcttctacaattttttgtacttctgaattcattttagtaaaatcagattttgcttcttcatctgctgttttccattgtctaaaatcaaccatcatcatttgtgttatcttttgtcttaatgacatattggataacaaactatcaactcttgaagttgtagcacttacccctgacatggccattgatgcaaccattgatagggacatagcagatgctagaactttcttcattctttttcccatatttttatatttccttcctcaattttgcacttaatattgtctagacatgttgtacaatatgtattgtaacaaaaacaaaatcattttgaaagccttttcatacataaaatttcatttttttattaaaaaatttaaaatattgttttaaaaaaagaaatgaaattaatcatttcttaaattgttgatgttgagcttgaatataatcatgataccacttaaaactatccttcttataacgtttatatgtaccatttcctaaattatcaccatctacataaataactccatatctttttgccatttcacagcttccagctgaaacaatatcaataacaccccacataatataaccaataacatcaacaccatcatcaatggcttcttctatttgtttaaaatgttgttttaaataatctattctataaggatcatgaattgaaaaatcactatttaattgatctcttgctcctaagccgttttctgaaataaaaattggtttttgagtacgatcatacattttattgagcataattctaagaccaattgggtcaatttgccatccccattcacttgcttttaaataaggatttttagttgaaactactaaattacctgctgtttgttgtccatcttcttgaacagtagcaattgaacttgaatagtaagaaaagctaacaaaatcacaagcatattcttttaacaatgcttcatcgccctcttccatttttaaatgaatatcattttctctaaaaaagcgatccatataacttggataatgaccattagctaaaatatcaactgcaaaccattgatgtatttcttcatctctaacggcttttaaattatcttctggtgaagatgttaaaggataataacaaaaacatgcgaccatacatcctgattgacttttaggagataattctcttgctattttaattgtttttgcacttgcaataaattgatgatgaagtgattgaaaaacaagactttgattataggatttgtctttttctttaactaaacctacgccattataaggactaaaataacctgcatttatttcattaaatggtaagaaataatcaatatattgtccccaatgttcaaaaacagttctcgcaaatctttcataaaaagtaattaattttctatttgtccaaccaccataattttctactaaatatagtggtacagcataatgattcattgttaaaaatattttcatacccgccttatgaacttctttaaaaatatgatcataaaacgcgattccttttttatttggttctaactcatcaccttgaggatataatcttgcccaacttattgaaaatctataaatatcaatccccaattcttttaataaagcaatatcttcatctatatgatgatatccatcactgccttttctaaaaggataatttccaataccctgacatttttttgcttcatctataacatctcgtgtgagtaagcgtgttgctgttgtagcatcagaagttctctttaaataaggtctacaatcttgtgtatctaaaccttttccatctaaatcataacccccttcatattgactactagcagttgctccaccccaaaggatatcttttttcttttgtatatataccattttatgtcctccttttaaaaactaaggtgatttctcaccttagtttctttgcaagtatataggcaccatattctggtgtatgaataggtggaataagattaaaacgatttcctaattgatcttgaagatgaggaataataaaggaacctgcatgttgaaatacaccgcctatataagagacgctaatgggggatttaaaatttttagataacaagttaataagtttatatatttcttctgcagcttgtttatatatttttaaagcattaggatctttttcttttgctgctaagccattgatataagctaaagcagctatttttgtacgatcatgatttaaattattcataaaagtaataatgtcataatcatttactaaatgacattctcttttaattaaatcatataaaatcgtcttttctaaacgaccatcaacttcttgacaaaaaacattcaacatctttttagcaatccaataagcacttccttcatcacctaattgatagccccaaccaccacaacgttgtaacataccttccttcaaagaaagcgcaatactacccgttccagcaatcacaacaataccatcttgaccatcaagagcaccttctattgctatttgtacatcactttttaaaacaaatggtctatttttaaatgcttttaaacaaatatcctctatttcttttcttatttttttatcttgtccatatcctgctaaaccaataccaatttttgaaacactttgtggatctaattgttcaactccagcttttaatatttcaatacatttttttggtgtttgacttagaatatgaacagttggtaaaactatttcttgacctatatttccatcatcatcataagaaaccatttttgtctttgttccaccaccatcaatacctatatacataaatttcaccttttatccttcaatagcttctttagctttttcttcttctaataattccttatcatacattttaaagaatggataatataacacaacagagattacaattaaaataatattcaaaactgctgctctccaatctcctccacatgcaagataagcaccaattggtccaggtaatgtccatggagcaattgtaacagcacaattaactaaatgcattgctgtagcaacccaagcaattgttgctagaactaaaggaataacaataaaaggaattaataacatcggatttaaaacaattggtgccccaaaaatcattggttcattaatgttaaaaatagatggtaagattgttgttcttcctaaagtttttccatatttagattttgctttaaaacagaataagatagctaatccaagtgttgctcctgatccaccaatatgcacaaaccattgtaaaaatggttcaacaccaatatgtgttgctacttttccagcagctaccgcagctgtattttggtctaataaaattaaccaaattggtcttgcaagagaactaacaatagaatctccatgaataccgaatgaccagaaaaacataattaagaaaataataattaatgttgatggtaaagtatctgttgcatttactaatggtttaataagtgttccgacaatactatgaacatcaatacctaaccacattgtaatggtagacattcctaaaataataataattgttggtgttaaagattcaaaagatcttgctactgctggtggaacagcagcaggcatcgtaatttttataccttttacttgtgtaaatctataaatttcaactccaataaatgcagataaaattccaataaacatacctgctgatcctaagttttctgcaggaataacatatcctgaaggaagttgttgtaaaaatgcatttaattctgcatttttacttgctaatgcagtaattgaatcagtcacatctggaatagagacaggaacaatcgttaataagaatgttaactctgccataattgctccacttaatccatctaaatcataagattttgcaagtgaataaccaattccaaaaactgcatataatgtcataatatacattgacattctatatggtaataaaatagctactgcattagctttgataaacttcgccaaagcccatgattcaggcatttgattatatgaaaatgcaacaaccattaataatgaacttacaataataattggtaaagtagcaatgatcccatcacgaatagcacgtaaatgtctttgattggaaagtttttccaaaggaccagcaaatttaccttcaataatgttcgagaacttttcaaacatattttctcctcctatctaatcattaatatcatcacaaaagccatgattgtaaatatacctgcaacaatccaaaagcttttacacattcctttttttctttcaatataaaattgtgaataagcaacagataaaccgcatacaattgaactaataattgcattaggaaggcgaaaatcaatatgtaaataatgaaaaccatttacacaaacaattaaagataacattgtagcacctaaaatcaacaatgcacttttaaatccaaacattggaatatcatagtctgttaccccaaacatatttttatatgttttatttttttcattttttacaacatatcttttcattgcttattcctcctataaaaaacttctaactgttaggctaatattacctttattcttttcaagagcttcttgacattctatttcatctttacccgtaagacccattaaaatagcaatcttaacattaaacttgcttttatttaatagtcttgttgcttctgcttcatcacaatcaacagattggcaaacaatagaaacagctctcatttttaatttttcatttgttggttgaacatcaaccattaagtttccaaatacttttcctcttttaatcatcactgaagttgaaatcatatttaaaaccatcttttgtgctgtcccagctttcattcttgttgagccagtgacaacttctggtcctacaacaacttcaataggataattagcgtactttgaaatctctccattttgaacacaacacaatgaaattgtagaacagccaattttgcgcgcatattgcaatcctgcaattacataaggtgttcttcctgaagcagcaattccacaaacaacatctttgtcatttaaatttattttttctaaatcaatttgtgctaattgcttcgaatcctctgcaccttcaactgcttgagtaacagctttaatccctccagcaataattccttggataagagtaggttcaactccataagttggtggacattcagaggcatctagtattcctagccttccagaagttccagcacctacataaattaatcttccacctaaacacattttttcatagatacaatcaaccgcttgagcgatttgtaatatgacgtcttgtactgcaaatgctactttttgatcttcattattaattgtttttaaaatatcaatagttgacatttcatcaatatgtaatgaattttggtttactttttctgtatctaactgatttaatttcattaatatggcccctccttccaatatcattatattattattgaaatattatttcaataataattgatatattttaaaatattattcctaaaataaaagattcatcttgaaatgaatctactttttaagaattgaaacattatttcttgaatcaatcaaattatctttatttttatcaaagttctttttaaacacaccataatacaataaatcagtaattacaaaagaagaaattcttgatgaaactgctcctatacgtaactccttttcctcgcttggtactctaagtgcaaccgtactattttttgatataagattttgattaatttgtgtaattgaaatatacggaatatttttttcaactaagattttagaaatatctaccaatcctgccgttgttcctgaataactgatgatcaatgccgtatcatcctttgtcatactttgcgtaaatgtcatttgaatatgtaaatcattattataaataacctttttcccaattctgattaatttttgttcaatatcattagcaataactgaagagccacctactccaaacagataaatagttgatgcattgcataaaagatttatagcattttctaaatcactaacattaatcaattgatatgttttcaataccgtattcatatttaaacgacatcctttatctactaaagatgtcatatcatcattttcattaaaaataatatctacatctaaatcatgttgctcatttgaatgagattgtgctaaattcatttttaaatcactaaaacctttaaaacctatttttttagaaaacctaataatagctgcggcagaagtatttgtcttctctcctaatatttgtgcagaataatttaaaatctcattaccatgttcaagaatatatttcgctattaatttttctgtcgatgtataactttcttcaaattctctaattcttacaaaaccgttcacactaccatctccttgttttcattatatcaatcaccatcaataaattctatcctaaaaaagctagtttcctagcttcacaaactatcacgaaaggtaaacatatggacaatcatcaccagtgatagtacacattttatgtgcatctttattttatcattatatttaacccactttgattttaagaacatattgctctttagtttttgtgtaatatcttctcttggattatctaaatgatattctttagcccactttctaaaatgtctattaatatattgattaagttgtaccatatctcgtttattaagataaatatcaactaatccaagtggatcttctactgaataatctttaattttttccatcatttgataaacaacttcattattcataatttgaaaagaatatgtatcatgttgtgtaacaatatctaaatccacatagtaattcatatgaacaactaataccttcattaaacctatttcactagacattgataacttaaaacattttacatcactatattttatatttatttgtccatattgaagataatctttataaaagtataaacaatcataaattgttccataatctaaaacgtgatcaactgctattttaacttttcttcttttaatataattattaattttttcatctatatgttctaaatcaagatgttgctttttgatcatatcttttttactttctaaaatatctctaatagatttcttttcatttataatttgtttgatttcttcaatatttacatccatttctcttaataaaagtataaacttaattcttgaaatgtcttcttgactataatttcgataattattgctatctcttgctggttttaccaaaccttcattttcataataaatcaatgttttctttgttacatttaacatttcagacaagtttatccttacctaaaaaatataataaaacctcgtaatataatattttctcttatttatatattctcatatttcaagattttatataaatttagaaaataaaatttaaatattatccttatgtaatatattttaaataattatctaaaaatctttttcttctacctctactataatacgacacatatccattcttcattaatacatactgactattctcactttcaatatattgataattcgctaaaaagccttgagatacataaccaaacatttttaatgataatcttttttcataatacttcatagaatgttttacaatataagtatttttttctgtaactatatgtgtatattgcccgtttttttcaatatataatattttagaagcatctagagaaatctctttacccttataataaatatcaatttgattatttactaacattttctttattttatttataactattggtaactcttctttaagatacttttttcttaaaaagtaatatggaaaagtttgtagtgcctcaaatataagatcctctctaaatgatacaaaaataactataatatcatcattgaattgtttgatttttcttgctatctctagtccattattaggcatatctatatctaaaaaataaatatcataatcatattcatcatcaaaacttgtgctaccatttattaagacatgatcaaattcacctgttaagttattttttaaactgtctataaattgaatatcatcatctattattttaattttcatatatatcacccaaacttctttataattttaaaacatattttatagattcataatccgctattttttcttttaatatatacctgttttctacctcgtattccatttccttttttggtttaaaaataaattctataatcataaatccattttttacattcacattaatatcaattttctttgtttcattattttgacaaatttcttgaaacaatgttaatacgctttgataatcttgtaaagaaaactcaattaatccaacattaagattatacaaaacctgctgattatatttatttgctgtatcttttatttcttctaataaaccattgaatattttattttttgaataaacctttatatgattttgatttattttattaattgtatttttcaatgtttttgtaagttcatcacagtcactttttttgttaacaagactcataaaatattccaaatcatgtttaatttcttcatttcttttattttgactttgaacagcaatatatttttcttctattgatttaagttgaataagttctatttcttgcttttttattctcatattatctttattaatacttaaaatgataatgaaaacactgattattgttaccataaaaataattgccaataaataaacataaccataggaaatactattcatataaataccatttgcaatgaagcttgttattaagcagtttaccaatgatattgaagtcaatagggtcaaatacttgttactaataattaattgtttaaaaatttgttttttatctaataagtaaagtgtaataaatatcattaatcttgttacaactaaaataatataataaacaatatcttgtgaataccatactccctcacttcctgtttttaatacaaaaattatttttagtatagacatactatcaaacatgcaaataactattcctataaatgttgaaataaacagattcattgttttactaattttattatctaatccattcattaaataaagaattgtaatcgtaataacaacacttaaataatcataaacgagatactgttcagcaataacatgacttaaagtaaaaataattgaaaaaaaggaaatcaaataataattaaaatctttcttaataaacttaaaatcaaaatagcctataataaatccttctatcaaataaagaaatatttttaacatattccttgttcctccaatccttctaaaaaataattataccaaccttatcaattataacaactgttataattgttcaaatgtcaataaagatagaacaaaagttctgcctctaaatttagctctctttaaatactaattttttcttttcaaataatacataattgcatcaacaacaaatgttgaacaaaacaatatttcagattcatttgaagcaccattttgaattacaaacatatataatgaataaatacatatgagcgcattcaaacaataaaaaccaaatttaaatgttttttcttctgaaaatctcatagtgtattcctcctcttatttatgatggtcttgtattactgaatttgatagttctactttttgcaaaatttttgtgattactatcattgtgtttctcttacattgctaggttttgcagtatcataagcttgataaaattttatatacattgtttttacaaattggtctccaacttttgatgcagttttacaaacaaaagaaattgttcctaaagcaggatgtgcccatttaaataatttagtcgtcttactaattaccattaaaacagtacataatgatttatttgttttataaaatgggccatagttttttccatatccatatgtgctaatttgtgattcaatatcatctaattctgtaacattatcgtattgcttattggccgaatcatcttcataaatcatttcacttatcaactgttctgtcccatcctctgacaacatataaacattttctcctttagaaatgacttaatatttttcatcatctacaatcattaaaagtgaattagaatcatcttgtgattctgtatagatatattgtcctgtattatcattataagaaatttgcgcatcgttatttccttttcagctaaaatacttaatagaattaatatcctcattatttactaattgatccaacttactttgaccttcttctgttgcattcatagttcttacctgtgaagaactcgagtttaaaaattcattatatgccactgtatttttttgcaataaaattatcattatgagccgaaacaattcccgcattacttatcataaatcctaatgctaaaattgtagtagcgatactcttatgtttcatgtttttctcctcctataaatcctcttgccttcggtaattcaaatttatattatttatataaaaaaataaacaaggtgtattaattctgttagttttgtattgattctgcatataaatagaaaaaatagtaaatcgcttgatttactatctcatcgttctattcacttttaaaagcattacactatttcaatccaacataaataatcagcaatcttcactttcattccatccaagatgtgtactctttgcataggacttactaatgattctagtgttctacaaaatactttttcacttaattctttattgttaatataaaatttcatttggtttcctgctttcttttaatgacatccatctgaagaatatactccaacaccatcatcttctccattaccttcatcatacaaatctaaattgaagtcttctaattgtaattctttatccatatttttccctcctttcttctataaccacttattgatgtaatttacaccagtaagctaattcaaaagtaataagattattttttaacatatctttatataatttatcatataaattatatatataatcactataagctacatttgtacatttctttaataatcctgtttccaaataatctaaagatatatctatttcattacataggacatttttagttgttttataatcactggttattaatcccactacttctaaccctaaataactacatattttatataaataattagatacttcatttatacctgttctatatgtagaaattattagaatacactttttacctttcaatggcatcgtatgaaaccaatatgataatctgtcaaatagtgtttttaaattacctgatatattatcaataaatattggtgttgaaataacaataatatctgcgcctaatagtttgttttttatttcaataattccatccttgttatcataaatacaatttccagttttaaagcaagttttacacccaatacaattatttataaaatttaagtaactatcatctataaaaatttcttctaaatagtatcttttttttatttctaattttaattgtttatagattttcattgttgttttcttctcattgtaatgatctccattaatatgcaacaatttttttgtacttttaattatcataaatataatcccacatagatttaaaattattatttttatttcttaaatcatttgaaatttcatttaatttatttacattcaactgttttcttaataatttatttatttgtgatgaaattgaagcatttttatttaatgaataggttgtttcacctattcctaattcttctaataataatccattcattctttgttcactactaattggagtaattaacattggaaccttataataaattgcttctaatatactattatgacctcctgatgtaataaagacatctgtttttgataaaataaatttttgaggtataaaactagaaatgtaaatattatttattttattttctcttatatagttatttaggggctctgaaaattttccaactgccataacaactccaatattaaattttgaaagagcatttacaaaatttttataataataatatgattgtgttacaaatgaacctgaagatatatatatgatttttttgtatgattcaataaattttattaatttatcatctatattttcttctattttaaatacagatttttctggtttgattattaaatactttctattttcataaaatgatgataccggttgaaatttttcacttgaaaaaattagtgtaaattcagtcattggatctaactgatgatgagtataaattggaaaatttttttccccatatttcttatataatttttctgctctctctcttaaatcaagaaaatattcatttggtaagttttttatacgccatttagcattcataaatacagcatataaatcatttggattctgctcaaagtatctttttgaataaatattatgtgtcatatatccaatgcatttaatattcattttatcagcaaccaatcttcctaatttatccacagcatctcgaaacattaaattgatgttaaatttttctacaatttcacaaatataatctatttgttttaatgttatatcaaaaacagattctatgtctttttcagttatataatcataaccttctttaattttaccttttttccatagttcgtctgtttttttcataaccaaatcaacatcaatattattacaagaagcaggaacaatataatcgggatattcaataaactttgcaccataactttcaagcatatctttattattggatgtactcatacaataaactacattttgtttatttattaattctcttattagtacttctacaagagtaatatgacttcttggagaagacattaacaataatatattcatttttattctcctatctgtatattatataatttggcataatcacctttattattcatcagtgacttatgtgttccttgttcaattaattttccatctttaagtacaaaaatattatctgcgatcttgacattagaaaatctatgtgtaacaaaaattcctattttatctaaaatattatttctaaaattcttaaaaaatgaatattccgcagatggatcaagtgcagcagtaggctcatctaaaatatacatacttgcacatctaatcaaagagcgagcaatagcaattttttgccattggccaccagataattgtatacctccagaaaaccaatttcctaattgttgatcatacttatttggtaatgtttgaataatatcatctgcacctgtcagtttagccgcttttattattttttctttgttattaatttgtgttatatccccaacaccaatgttattttttgcatcaaattcataattgttataatcttgaaaaactgtagaaattttgttttgatagtctttcatatcaatttttcttaaatcaatatcattaactaaaacagttccttcataatcagtatataatcctgttagtattttaattaaagttgttttacctgaaccattttcaccaacaagtgcatttatttcgccagaatttaattttaatgagatattctttaacgaataattttttctatttttatatctgtatgaaacattttttaattctatatttttaatagaatctatttttattttttcttcattattttggtactttttattgtccactaatctaaaaaaagataaaatatattcacaataaacactatccgtatataatgaaaaacacgaactagcaatattattaattgcagattcaactttagtagtcgtattaatataagtcattaaactccctaataataattttgaagataacgcttctaacatcgctaatgccacaattattagcgaaaataatgtatttaaaagttgataaaagaaattaaaaatattttttctcttattaataattatattttcattaaatatttctttttttatattcttaaattttcttattaaatattcagataaatttaacattttaacttcttttacaaaataatctttaataattaaatgtgataaataccatccctttctttcattttctgctcttttgtataccatatcgtattcttttttattaatttcaataaaatatttgtaagctgcaaatggtaagataataaaccctatcaatgaccataaatgccaatttgataatataattaacgaaactataaaacttactaaccctgaaattaaggacaatatatttttaaaaagacttaatggtctaatgcctatttgttgttctgctctttgtaaagcatcatatatttgtggattttcgaaatcttgataatcaagccttgaacatttgtctaaaaataaaacatttaaatgataaaataaataatcactgtacttagttaagtaatatgaattaaaattattcaaaataagggaaaccatttttatcgttgtatataatattaaaactttaattaaagtacttttttcccctccaatttgaagcatattaagcattttttgagaaataataatagaaataaaaggtaacgtactaactgaaatattcaaaaataatgataaaaatatatattttttttcataccttagtaaaagcttcatggtttctataatattttttgaaatcacttttgttttttttagtatattatttctttccataatatttttccctcataatttggttataaataatttttcttaaatatcccattgttctattttctaattttctatttattcctatcattcgattgaattgcatatgaaaaatacttaataatattcccttttttctttctttagaattgatgctactattaattttattccagtaactaataaaatcattctcatagttatctaggttaattaataatcttattccttcttctgaagttctataattttgccaattatcatgatttttcaaataatgccctgttcttatttttatttgttcaaattctttattatatttttttccaatattaaaattttctaaatagtatagtttatcttccgaattaatatctaaatcttctattaacttataacaacttataataaataaatcagttaattttaattttgtaaaattgtattcatacaattttagaagtcctatagctaattcactatttgaaaaaaaggtttcttctgcaaaataaaagttattagctcctccatatctctcaaattcttgaaagtatgtatccataacacattctgttattaaattattttcctttaaatctttaatcatatcacttacaaatcctacaatatcttttaatttctcattggaatacttaattcttagtcttatatgtgattttggatccttatatctaataaaaaatagtctactattatactgtttttgttttaaaatattatttaattttgaaatagaattaattaaaatgtgattatgtacatcgtcattggaatacaatttaatacttagccaattttctaaaggaaattttgaatacattaaatatttatttgtatctatatactgaatatcatctggtaaaattaacttatctttatattttttttgacatggtgataaatgaactattatctcactaacatatttttcattattttcatcatatattggaagatttgattcttcaaaaatattttcataaattcttaatgtactatctcctttaagtagattatataaaatatttaaatgtaccctattttctacatttaaaagcattctttgatctaatggtcctacactaactagattagaaaagttgtattttttcttcatttcttttatatattcatatatattttttaatgttacatctttgtttttaaaatcaaaatccttcggcaatgtataagaagctggaaataaaataaaatttttgtaacttattcgtggcaaataaccttttacttgtaaaatatagtgttgcaaagctgtataaaaacttgtaaataacaacttctgtttattagttacctcaataagtgttcttaactcttgtggatatgcatttatattgaacatattagatgcataaaactctataatttcatttgtagatttttgaacaaacctaatatagttttgattatcaactattacatatatatcttcgatatctattctttctttattttgaataattgtatttgtcccatattcaacatatgcacttttatttgatttacacatcataacattattgtatcttgcattttgaggtataaaacatacttcaacttccttaactaaagaatccattttatgcttttcctcattagaaaataaatattcgaatcttcctgaaattttatattccgtatttgatcccatcaagggacttatcatatattttaacgtatttttttcattatataaatataaagctaattctcctcctgtttgcgaaacatcttctttgtatgttatattatttaccatataattttctaactttaaattatttgttttattttcagacattgctaataaaatttcacaaataatattatcattatattttaaagaatttttatcatcggaatgtggaaatcctaagcccgtttcttcatctattaaatcaagatatttcacagcctgatttccatatttttctttaaatttcatcgaataatcaaaaaatgtttcattatatctatatttagcaagaaaatttgcaaaatcttcaatatcactttttactttgttatttaaagatatttttgacgtattatacatatctatttgaagataattatcggatacattaatactttccataaaattaattatatttttataaatttcttcaccttcacctatatcagtcttttcataattatctaacatacttcttagttctaataatttacaaaataattctgtactaacattgtatccctcaagtttttctaatacatatcctaatggatcagtaattaaagtatttggtcttaagtcgcttattaagaattcattgtctagtaaactactaatgaattcaattattgattcttctttaacaccaattgaatttgattttaaatttttgataatatcttcaatagaaatatattgtttacacatatcaaatacatactttactgctttggtattattaatatatatctttctttcactttcacgtgcatttttcacataacaactattccattttttcaagaccttttcaccaacaaatctattggtatcatttattattacctttagcttaatacctacatctttttctaatttttttataatttcaattaaccaagacatatcaggcctagattttttatgatgtttcttatgtatatttaatatattgtcttctttaaaatttccaatcatcacactcgaatttaaaccatatggtgtacatcttgttgagcttcttattaaatatttagttaacgaaatcaattcatcattatttattttttctttttttgaaataatatcatataagccagatgaagatatcaataaattttctttaaatttatctagtgataaattctctttgttttctattgattccttataataatcaaatgaattataaggtattcttatcataaaatcatttttgcatttcattttttatatcctcctctttatactaaaaataatgattttgtgtacatattataaaaataattactttcttttaaaaaatagggtattaaaatcgaaaataaaccatctattgaatttaatttttcatactcataaatatctttattatttatgtagtctttatcatatttataaaaataatacttattatttttatttcccatttgccatatttttctttcaagtacattacttaatattctaaaataatcatctttagtttctatataaaataaattaataattaaatataatccagaatacccatgacaaaatgtagggcattctaaatttaaatcatttatatctatttttttcatttcttgtatcatccatgattttaattctatattttctgtattattagcagcacaaaagagtattctaattattcccaatttcccgtaacaccatgcaaatctttttttatatacatattttctatcattttcattattggttataatctgtggccaatatgtatcatttgaaaatacaaacatatttatataaaattctaaaattttattatatgtttcatctaatttattacattttatgttattttttttcgcaagagaaaatatatacaagaaatctataattccgtgtgctgctcctaaatcaatatacccttctgaatatttttttttaaaaattggatttgttatgtatttattttttatccatatattttttgatttaattatttcacaatcttcctcaaataatttaatcatccaattcaaacattcttctatataatttaattgttcattgtgatatgtaataaaatatgacaaaatccctgttaaaccatttaataaatcatattttccattaaacaagtcatgatttttcccattaacaattaattttaaagattgatctttaacaaaattttctattgaatacaatatttgacattcaccatataattctcttatcatatatgctattcctgtaaatccgtaccaactacccaatggaatatcatacttttttaggttattaagtattttatttagttgatcctttgaatattcaagatattgtctatatttatttaaatctgtttttttataataaattgccaaaaaataataatatataactaaatcaaatgtttctgggaaattatttggtttataattttctaattccaggtttatgttatctataatattctttttcactttcttcattttttcgcctcatctctttgacatataaaaaataacacctataaagcataaaaagtattaatttgttataagttacacatatatggcacaactctcctctattaacaaaattaaaaacaaattttacatacttaatattttagtattattcactcaaaagatagtcttattgaaaataacactgtaaatgccaaataaaaaaagccgttcaatttgatctgataatcaatttaaacggcttttctttcaaattcttcttttatctcttcactccatggcaaaaacaatccagttttctagattttcaactaaatcttattgaggtaaataattcaggataaattcaatataatcatatagatccagtttgttatcttttgctatttcgatcacgctgaatactatcaactaccttagtagaagttgaaagcagtcagttctttcgattgtgttctataacacataatttcaatcaacagtaaatatattctgcatagaatatatcacctagcataataaagctccggtaatatttgttattgtttttatatccatatgacaagaaacttcgattcgtacgtcgactttggttatatcaatattttattttttagattactctaatctatagaaacaatgtttggaattgaaatagctcccgattcaactgctatagttcttactttcttaagccgtttgtagtaggtcttacaccacattttaattggtagcccactttcttattatcttcatccattgctttgttttgatgtcgttattaatactcttaacatttgtaaaggataaaataaaaatgttagaaaacccacaaaattatttagtccaaaatctacatttttatattgacttttgcaaacattcataatctcatcttccatgtatagtaaaattaggcactaaaactactataattatcattggtgatttactatattttcatccattattttattcgtcgcttacataatatttcacaaattgatactgataagaaaaattatttgaaaataaaaaaatatcaacattaatataactattattattaatgttgatatcgcttttttagaaataatcaaaaaaagacatataatttcaaatttttattattactcaatagtggataaataaaaaattaaaaattttctatattatacaaaatttttatttagatagtgtcccaaggtaagaaagattccaaatctttcattattttaaatatttaattgataatcatttattggattcttgttagttaatatttctttttgttttgaatatgtaacatatgtatatatttgtgttgtcgatattgaactatgtcccaatatgttttgaatgtatctaatgtcaacacctttttcaagtaaagttgtagcaaatgtatgtctaaacatatgaggggttatatgtgtcgaaagttctaattcactttctatttttttcaacaatatgcgaacggtttgttccgatagctttttattgaatttgtttagaaaaaaatattcattctttttacatgtattattataagttaggtacatttgacataattgaactacattagaatttcccaaatataaaattctttcctttgatcctttaccaaatatttttaatttcttttctaataagtctatatcttttaattttatattacataattcagatacacggattccagttgaaagcattacgcttataagtgtaatgtttcttaaggatatctttttttggaattctgtctttgaattttttaagtcttttaataatagatgaataattttatcgatataatctttttgaattgtttttggtagtaatttaggttcttttatttttgtttttattttattaaatggggaatagtctattatttcttcatattctaaataagaatagaaagcttttacacttgctatttttcttttaatagttttatattttaaatattttttatttaggtaatgtatgtattcatttattattttttgatttatttctgtagtagtaataaattctaaatattgatttagatctattgtataggcttttattgttttttcatttaatctttttctaaattcgcaatcttcataataagattctaattgtttttctaattctatttttttcatatcatatttctcctttaaattacaatatgtaattatatagaaatgttaattcttttatatacccttttatagcgataattagaagttatcgatataatgatactgaaagggtgattaaattgaaaaaaatgattggatatacaaatggagtttttgatttatttcattatggtcatttagaatttttaaattgtgcaaaaagtaagtgcgattttcttattgttgcattatgcccggatgatatggttgaaaaatataagaataaaaaaccaattataccatttgaacagcgaaagaaaattctagagcatcttgattgtgtagataaagttgtaacacaaatatcaacaaatagaatggttgaatttgacaaatataaatttgatatatattttcatggtgaggatggctttgaatttgataaaaatacaggaaattatgataacttacttaaacaaaatataattgttgattatattcctagaaaactagatatatcaactactaacataattaataaaattattttaaattattcaaatgaaaaaaagtaattttataaaaaaagttatcatttgtatatatatattttttttgttaattcttttaactattctttattataacccacataaatggtttgatattttaaccatttttcttacatctattctatttccttttcttatgtctataattaaaaaattaaataaaaaacgtaatttattgaatagtttgtatgctgaaaatattccaagtcactttattgatagaacaaaagcattagaagaaattataaagaaaataaataataataataaaataatttttatttctggaggaaatggaataggtaaaacatttttcttattgaaagtttatcaagaaattacagaaaataaatataaattttattctaataaattatttccaatatatcttgagttaaatgatgatatatctatagaacaagcaataatgaataaaataaaattggaagaaaataattatagttgcaaagaaattatccaaagacttagaaagataacaaaaaatgatatagtgattctagttgacaacaattcaacaaataattatcaaaatatgatgtcatttgttgaatcattacaagagctagataatggcttaatatttataataagtaaatacacttcctcaccaaatttatatgaaaataatatcgaattagaaaaattttcaattaaagaagtaaatgagatggctagtgagtataatttaaatatacctcatgaaatttcagaaactattttcaattattcaaatggaattcctattttaataaaaatattattattcaaccaaaaagttgttaacaattctcataacagcattcctgctcaaaattatattcatgaaatttgtcaaagacttgataaaaattctttagaaatgttaaaaactgtttcattttttaatattttagaagaacccatgaattattcattatttagaggcataaatattaatttttcaaaaaataatttacgcattttaaaagagcgaggattaataaatagtacgaatgacaaaattataattaacaactacatagcttttttaataagacaatgttatgatgatgaaagatttgattattataatagttttatagaaaaaagaataaaaattggttactcagatgaaaagtatatttttcttgtattaaatagtcaaaataatgatctatctaaattagaaataaaaaattatttattaagtttttttaaaaaaagaaaatatacttattttattaatttatatgaaaaaacttttatagaagattttaatttaaacaataattatgatgatgaagaaataagaaattatttaatgtatatgtattttcattctttattagaattaggtgagtatccaaaagcaattgatttttttaataatgaagatctatgggtatctaacataactttgctagatcataaaacattttcttttgattttaattttgattctgctgatttatatcattttcaagctgaatacgaaaatgcaatagaacaatatcaaatattaaaacgtgatgaaaaaaattcgttaaaaaacaacttaaaatgtcaatgggctatagcacactgttaccgacatatgggctcagaaaaggatttaatttattctttaagtatatcggattctatttgtgaaaaaacaagttcaaaaaaagaacttttcaatttatatcttcgaaataagatgtccattattatgattaatttatatttaaagaatacaaattatgactatgaaaaacaatttaatagattaatacaaaaatgcaatcaatattttcttgacaataagaaaaatgaaattttaaatagtagacaaagagcaattttctacaaaataataaaaaaagattatgatactgcatgtaaaatgttgtattcttctatacaagaacttgaaaataagaacttaagaataaagtatgattattattttgaaattgctgaagtatatcgcaaaaaagcacttatcaatatttcaaatgaatatttaactatctcaaaaaaatattatgaaaaatcgcttcgctttgctaaaagagtaaatgatgtaaatttagaaatgattaatcaactaggtattatcatttcaaatatacaaaatgagattcttgaagagaagcaattaaatattattttaaaaatagaacaatttgccaaagagaaaaaaatattttatatattaaattggtgtgcaagtattagagagtatttaacaattgcattacatgataaatcaaattcaagggtaaattatttatatgaaaaagtagtaaatattgatctctttgtaatgtaaattattggatatcatgtaagcaagattaaatcaatatatttgattgataaaatgacattctaaatttttatggttttaagaagtcgctaactttataccaaatttagatttaaagataaaagacattagatttattacgttttgaaggtaacaattaatgtctttttttatggatataatatcttactttattatgatatttattttttggctacttaacaatgaaaaaagttttactattacgttcttgctaagtttctataacggtaaattgactctttaatactttagatattcaacagaatgatacctttaactttttattaattataatttaaataatttatttgttaaatctattatgttttcttcaaatgtatattttatcatttttctttttgataaatttttaacttctgaaattatataatttgaataatttgtattttcatcaatacattccaaatatactttgtatagtacttctgatattatttttagttcatcgtaattccaaccgtacctggctattaattgtgtacctatcctaattccagaaccattatatatttgtttctttcttgcatttaaagttattttataaacttggcatcgcattataaatttatcaactatttttgaatccatcaaaataaaaatttgatgagtttctgtataaattttatccttttttacaatattaaaccctttttcttctaataattttcctaacatgtttgcaactttcaccatatgctcacagtattctttaccaaaaattgaaaattcttctaacgtaaatatcaaactcattatttgatggagttgtacatttcttagataatctggatttatttttaaatcaatcttatttataatatcagaagaatttgttaatattaatccatttgtaggtcctggcaatgttttatgtgttgatcctgccataataaactgataggaactatcaaaaaattctagatagtttcttattttttttgatgcgattaatcctaaaacctgtgtagcatcataaataagaattttatttttatccatttttattttttctaatttaggttgaaatatcatatcagattgacatatcaaaataccttttatactgtcatctaataagagtgtgtttaacttttcataatcaaaatcatagttattataatcatatggcatagaacatgttttaatacctagtcttttacataattttggcatagaactatgacctccacattcttcatcgctgattaatattttatcattatttttaaaaagggacataagtaatagactaattgtatttactccagttagagttcttccatcagcgtacatacttttaaataattcagaactcaatcgatttaataaattgtataattcaaaaagattattacttccaataaagttattatgttcttgatattcttcaataccacccattatgtatttatcttgaataaaagattttaaaggtatttttgtaaattcagattgttcattctcagcagcacataatggtaaacaagatttttcaaaatttgttattggttcgtatactttctcacataatttgtagaattcatcgtatttcatatctatatttctccaatataaacaattgtactcaatggaaaataaactaaattaccttgagcgtatttatgaaatacttttcttaaatcactaatatataagttgtatttactatctttattggtcaaagagtatgaagccgataatgctcttcctatatattcctcttctgttaaataatttaaaccatcatcaatgaatttataaaaacgtggttgttctttaaaaaaattattgaatgaatctttttcaaaagaaaaactatgtatatcatctttatatactttactatatttttttatagtcttttgtgtttcaagacacaattcattttttgtttctttgctattccatactaaaataactttccctcttttttttaaaattcttttaaattctttttttgtgtcttttaaatccagcaattgaaaagcttgtgcaacagtaattaaatcaactgaattatctaataaagtagtatgttgcgccgtagtatttattaaacaagtatttttctctaaaatatttctttttaattgcttgtacatatccttatttggctcaattgcaataacttgatttacatattttgataaaattgttgtattaattcctgtacctgcagctatatctacagcaatttttattttgttttcataaatctctttacataataaatttatataattattactgtatctcgcccttgctttatcgtatattacagctttttcattaaaaatttcataattaaaatcaaccatcctattcatcctttctatcgataacttctaattatccatacttaatattagcatttttatgcattaataacaaatttacttatataggtacaaattttaataaacctttattccaaatttttggtataaaatattaagaaaattaaaataattcctgtaaaatgaatacaaaaaaatactttgttatttattcatattttacaggattcatttcattttttatcttaatttttattttattattatcaatttatatattgattatttaactaacatccatttcaaaatgtttaaattagatttttgctatttcatcaagatattcttcacgttgttgaattatttgtaaagtactagatgcagaatctaattgatttttaaccttttttgctattgtttccgtatcattaattagattttctaattctttcatatcattacactccattataaaaatataaataaagaatttctttgtcatttaaaaatattttcatttttcaaatcccataaccataaatagatttgctacttaaattataacttttttctctaacctcatctttgcattaattgttttaaagctggttttccttctttattgacaaccacatcatctcctaataagactgcaaatggttcatctcctataaaagatttagcacaaagtactgcatgtcctaatccttttggttccttttgtctaatatagtagatattggccatatctgctatatcttgaatcgtttttacttgttctagttttcctgattcttttaatctttcttctagttcatagtttttatcaaaatgattttccattgcatgtttattactgtttgtaataatcaggatttcttctattccactgtctactgcttcttgaatgatatattggattgttggaatatctacgattggcaacatttctttagcgattgcttttgttgctggtagaaatcttgttcctaatcctgctgctggtataattgcttttcttacttttttattcattttttctatcctttcttcatatagaatatttacttaaaccatatcatttttttaatttttatcaaccctttataaccaatatgctattttaattacttaaatactcatctaatttaaatttttataattttaattacatgtatgattataatatcaataaaaaagcaatgtttttaaatcacattgcctctaataattatttcttttctacaatatcattaagttccttaaaaattgaattttctggtacaacgcctcttactctagataatggataaatattactatttcttccaataacagttccagggtttaaaacactattacatcctacttctacataatctcctagcattgcacccatttttttaagtccagtttcaatttcttcatggttaaatctatcttttacaactactaatgtcttatcacttttaacattacttgtaattgatcctgcacccatatgagacttatatcccaaaatagaatcacctacatagttataatgaggaacttgtacattatcaaaaataataacattctttaactcaacagaattaccaataacacaattttcccctactaatgcacttcctctgataaaagcacaatgtctcacttctgttcctgcaccaataatacaaggtgaaccaatataagcactatcaaaaactttagcatctttgtgaatccaaacatgttcattcacttcttgatattcatcccctaaagtttctcctaattcaataataaaatctttaattccttttaaagcttgccaaggatactcatattttgataaataatcctttgcttgactatgtgttaaatcatataaatcatttatcttatacataaaaacacccctcctacttatcttcttcataaaacaattgtaatacaagctgttttaatttactataaaaatcatacattttttgaagtgttattgaataatcatttgtaagtttagttttcaattgattaatataagtttgaatatataatttttgtctttgcattcttgttttattagaataatcttttgaagtattacgtgaacgtacaaattcttcaacattatctcgattaataacaattttcttttgttttttcaatctattcccctaaactttagcaaaaaataagcaggagccttcgcctttgctacaaacacttataaaaacctatcttcgaatatctatttccaactttgccttaaagcaaaccatgaaatggtcttcaaatatcttgatctgctcgatatactttcgaaccagcgcttcatctataaacgtcaccacacttgatgcaggtacaaatgatggatcaatgacctgtaggattgcatcgcacagcagactacccatctcaccgaattcgacgaatcactggtgcgacgctggatccaacagataatcatctgagatgaccacatcaccgtccaactgaaatcaggtgttagtattgatgttaatgcataatttcataaacgtacgaaaccctactgaccatgatggccgggagggttgtcttcactttattcatctaacatattatctatatactgtataaattctgcacttttggctacacgtccatttcctccatgctgtttatatatttcgtatactctatttcgaatatcttcaattaaggtatccgttacagaatccatatccaagttcttaatatcagcgggagtaatatttctcttacccaatacatctgcaataactgcatacagtacataatataaaatatcacttttttctgctgaagaataatcagaaccacttcttacatttttctggatttttttacctagtaaagctactctataaaatacctctagattattattcttttcgtataattcgttgtatgttttttcgtcattcagcaatgttgatggtcttgctcgtgcatagtctggctttttcaggaaaattgtaataagacattgtgcaagaaaagataccccaacaatctccgcaggcttatgtccctgatttttataataattttttctcctatcgtaaaataatcctctactcttaaaatacatttcaatttgaagatgtataggatccgtcacacgcaatgttgctttaggaatatttgtctgattatttgtagcaaagataatttgatctcttgattcttcattatcaggaacaattatccttagcaatatggaacgtttttctgactctaatgcttctctattttcggaaaaataattatatatttccattgaagtttgtaatccattaacaatttcaggattaacaatttgtaactctctattatttaccaatgtagcttcggatgccagtactgtaactccattatttaaccaccaaaaatcattatcatcggctctatgtaatgtttcggatatactactgtttacattattttttccttgataatcacgcacattagaatcgaaaaaactctttctcacatcgccttcatcatttactataaagttaaaatagcttttcaaatcaactaacgcaacataatttttttgatttggcgaaattggaatatctgcaaatttaagattcactctattttctatcaccgcattatacatttcaaacagagtatcagaatcaacaaaagttacctcaacaactgcattcgggaataatccttttatggtatctttcagttcttcggcttgctgaattacattaggatgtaattctgatgctaatgttgcatagtaaaatctaaatttcaactttaccctactggttatcaaacgtgtatatgtatccctaaacgtagtaaatgcttcgagaatatcggcattataccttgccgtaaaatcagttgttgtttttgataaatccagaagatttccagagatggttttccacttcatcactgcatcttctccaaatgatgtggtcttctttgactggataattatcatttccagaatggaatcttttggtgcagatatatgttcaacaacatctggcgtaataagtaaattatttaaaaataaataaatcgaatcgcatcctccatccaatccttttccaacaataccattatctacttcatcgtcacttaatccttgatttttcaatatttggcttgctgaaaaaaattcaaaatattctgatatgttgctatagttatcattatttcgaaattcttgttcaattaaattttctagtaatatttgtgcatttttactcatcttttaacctccacatacacaataattttcctgttatatatttcactgtcaaatccgcctaatagtattgagtggcttaaactgcggttgtctctgacaacaatcccaatgccacaacctatgacatctaatccacagcctaaaacctacaacatttttctgaccatccactttttttctctggtcagactaataagtagatatgtttccatacaagaaagtcgagctttccgcaaggcttctctaatgatgctaactaagcaaaaaatccggaaatgcgctacttttcagcctttatttatcttttcttgacagcaaacacaccgtctcaacatgtcttgtatgtggaaacatatcataaagatacattgtatgagtatgataaccaatctttttaaagtattgtatatctctaatttgtgtcgttggatcacatgaaatataaacaacttgtttaggatttaatattttaaccgaatccatgaattgtttggttgaaccacttcttgggggatccataatgacaacatctactttatgcttttctttcgcaagttttttcataaattcagtcgcatcatcacacacaaattgaatattagaaagttgattcattcgtgcattgttttttgcatctttgattgcatctttattactttctactccaataacttgttttacattttgtgagagaatcattcctattgttccaataccacaataagcatcaattgctgtttcgtttcctttaatattcaataaggataaagctttggtataaaggttcacacattggtcatgattgatttgataaaaagattgtggagaaatcttaaatttcaaaccacataattcatcaacaataaacccttttccataaagaactttatcttcatttcctaaaacaattggtgttctacgtgtattgacatttaagacaattgttttaatacttggaaacttcttaactaattggttgcaaaattgcttagaaccacgccacatattttcattacatactaaaacaaccatcgtttgatctgttttaacacctcgacgaattaaaatatgtcttaataatcctttatgtcttttacgatcataaatagaaacacgatactttcttaaatagctttgtatatattgtaaaatttcatccataatatcttcgtgtaataaacagtgtttataaggaataatatcttggctatgttcttcgtagagaccgtattcatatttttgattaaaagcaacaattgctttatttcgataaccattaactaatggtgaagctactgttggttttacatctatttttaattttgttttctttatttctttttctataaataatgtcttttcttttaattcttcttgatattgatcttgtggataaaagcatcctccacatcttttaattattggacatttcattttttatcaccctttacttgtcaatcattataacataggtattatcatttgatgaaatgatttatgagtgttataatctagcggaggtgaaatatatgagtaaaatagatattatttctggctttttaggtgctggaaaaacaacattaattaaaaaattaattgctgaagcatatcaaaatgaaaaaatcgtattaatagaaaatgaatttggagaaattggaattgatggaacattcttaaaagattctggtgttacaatcaacgaaatgaactctggatgtatttgttgtagtttagtaggagatttcgaaacatcattaaaagaagttttagatacttatcatcctgatcgtgtcatcatcgaaccttctggtgttggaaaattatctgatgttattaaagctgtttctacaatcaatagtgatgaaatggaattagataattttattacagttgtagatgctaaaaaatgtcgtatgtatactaaaaactttggtgaattctataataaccaagttgaacatgcatcattaattgttttaagtcgtagccaagacttaactgaattccaattaaaagaatgcttagatatcttaaaaggattaaacgattattcaccaatcattacaactgcttgggataaattaaatggtttagatatcattaatgcttgtgaagtgaacattcaagaagaattattacatgaacatgaacatcatcaccatcataatcacgaatgtgaatgcggacatgaccatcatcatgaacacgatcatgaccatgaatgttgtggacacgatcatcatgaacacgatcatgaccatgaatgttgtggacatgatcatcacgaacatgatcatgaacatggatgttgcggacatgaccatcatgaacacgatcacgaacatgaatgttgtggacatcatcatcaccatgaccatgatcatgaatgtggttgtggacatcatcaccatcatgcagatgaagttttcaatagtatcggatttgacactgttaaaaaatataatgaagttgaattaagtgaaatcttaaataaattatgtaatgatgataatgttttaagagctaaaggttttgtagatagtggaaatgaagattggtggtattttgatttagtaccaggtgaatttgaaattcgtttaggtaaacctatttatacaggtcaagtttgtgtaattggtaaagacttagatgaaaatacaattaaggagttatttttaggataagcgtatgaataaaacaagagtttatttgtttactggatttttagaaagtggaaaatcttcatttatccaagatactcttcttgaacaaggttttggtgaagatgaaaaaactttaatcattgcctgtgaagaaggtgaagtagaatatgatattcctgctttagaaaaagaaaatgcttctgttgaatttattgaaaacgaagaagatttaaattatgaaactcttcttcatttacatcaaaaataccaaccaacacaagttatgattgaatataatggtatgtgggataatacaaaatttgttgatgaaatttgtattgaccaatggcaagttgttcaaattcttacaactatttctgctgaaacctttgatctttattacaacaatatgcgtggacaatttgtttatcatataacaggtagtgatttagttattgtgaatcgttgtgatgaaaatacaaagaaatatcctattagaggaagtatcaaatctttaaatccaatgtgtcaaattgtttatgaaaataaaaatagacaaattgaagatttaactgttaatgatttaccatataacttaaatgatgattatattgaagtaaatgatatggattatggtattttctgtatgcatattatggaaaatcctcaaatatatgaaaataaaacaattaagatcaaaggtaaagtgattggccgtgataaattaattgaaaatggttttgttttaggtagacaagccatggtatgttgtagtgatgatatgcaacttttaggtttagtatgtattagtaaatacgctaaagatttaattaaagatgaatggttagtggttgatggaaccattagtttagaatatgatgaatctattcaaagtaatattcctattttacatgttgatcatttagaaggtgctaaacctttagaaaatgaatatgttacatttgattaagagcttttagctctttttctattttatttataaatactttcatgtataatgaataggcaaaaagaggtggaaaaatgaaagatttttggtatgaattaaaacatgtttgtaaacaaagtggtgctcgatatgggattttacatactccccatggagatgtagaaacacctatgtttatgcctgtaggtacactagctacagtaaaagggattgcccctgaaatgttaaaagaaatgggatcacaagtaatcctttctaatacatatcacttatggttaagacctggggaagatattgttgctaaagcgggtggtcttcataagtttatgaactatgatggtcctatgcttacagatagtggaggatttcaagttttttctttgggaaaaacaagaaagattaaagaagaaggcgtttattttaaaagtattattgatggtaagtctttattcttatctccagaaaaagcaatcgatattcaaaacaaattaggagcagatatgattatgtctttagatgaatgtgctccttatccagcaacttatgattatataaaacatagtgttgaaagaacaattcgttgggctaaaagaggtaaagaagcgcatcataatgaaaaacaagcgttatttggaattgttcaaggtggagaatatcctgatttaagagaaaaatgtgccaaagcacttgtagaaatggatttccctggttattcaattggtggaacaagcgttggtgaaccaaaagatgtgatgtataaaatggtcgaagatgcaattcaatggttacctgaagataaaccacgttatttaatgggagttggtaatccaattgatttaattgaagctgcgattcgtggtattgatatgtatgattgtgttttaccaacacgtgttgctagacatggtgctttaatgacacatcatggacgtatgaatattaataatgaaaagtttaaagaagattttactcctattgatcctgaatgtgattgttatacttgtagaaattatacaagagcttatttaagacatcttcataaatcagatgaattatttggaaaaacattgttatcgattcacaatgtaagattcttattacaactttcagaagatattcgtaaagcaattcaagaagatcgtttattagattttaaagaagaatttttagataaatatggtagagatgtttataagagggctttttaaatgaaactaagtgaatttgattttgaactacctgaagaactcattgctcaacatcctgttgaaaaaagagatacttctagattaatggtagtaaatagagaaaacggaaatattgaacacagacatttttatgatattcttgattatttaaaaccaggcgatgttttagtaagaaataatacaaaagttattcctgcacgtttatttggaattaaagaagaaacaaatggacatgtagaagttcttttgttaaaagaattaaagaaagatacttgggaatgtttatgtggaaatgctcgtattattaaaatgaatacggtgattacttttggtgaagggttattaaaagcaaaatgtattgaaatcaaagatgaaggtattcgtgtttttgaaatgatgtatgatggaattttctatgagatcttagatcaattaggaacaatgcctttacctccttatattaaagaaaaacttgaagataaaaatagatatcaaacagtttacgctaaaattgaaggaagtgcagcagctcctacagctggtttacattttactgaagaaatcaatcaaaaaataaaagataaaggtattgaaatcttagatgtttgtttacatgttggtcttggaacatttagacctgttaaagaagaaaatgttttagatcatcatatgcatagtgaattctatatgatcagtgaagaagtcgctgataaattaaacaaagcaaaagcaaatggtcaaagaatcatcgctgtaggaacaacatcaacacgtactctagaagctaatatgaaaaaatatggtaaatttacagcaacaagtgaaaatactgatatctttatttatcctggatataaatttgaagctattgattgtttgattacaaacttccatttacctaaatcaacattattaatgttgattagtgcctttgcttcaaaagaacttattttcaaagcttataaagaagctgtcaaagaaaaatatcgtttctttagctttggtgatagcatgatgattttataatgaaaatcaattacgacttaaaactcaaagaagaattagaaaaaattaaaggtacaaaacccaccctacttctccatgtttgttgtgggccatgtagcggaaacgttttaaaagaaatatctgaatttttcgatataactatttattactctaattcaaacatttatccagataccgagtattttcgacgatttcatgaattagaaaatttcattcaacgctttaatcaagatttcaatcaaaatattcaagttgttgaaaaagaatatcaaccaaaagaatatctaaaagatatttctcaatataaagatgaacctgaaggtggaaaacgctgttatctttgttattcaaagagaatgaaagatgcttatgattatgcatctttacatcactttgattattggtcaactgttttaagtgtttctccacataaaaatagtcaatggatcaatgaaattggcgcaagctttcctcaagaaaaaacacaatttcttttcagtgattttaaaaagaacaatggttatttaaaatcagttaaatttgcagcattatataatctttatcgacaaaattattgtggttgtgtttattcttatcaagatatgttagaaagagaaaaaaacaaggagttataaaaataattccttgttttttatattaaagccatgttacttcattaccttttctaggcaatacttttcttaaaggctttccatcatttgtatcaggataaccgacaattaaagaaccatagaccctttcatcttcattcatacctaaactttgtaaataagataaaattttttgattttcattgagccattttaattgattaatataacaacttcctagatctaattcattagcttcaagcatcatattttcaagagcaagagcacaatccgcttgattatttccataatcttttttattggcaacaataatcaaaacaggtgcattataacaaaatacatatccgccctttttagaaagattgattgaattttgtaaacttctatacatattttcggtaatttccatttgagaaaacgccctttcaaccattttaactaaatgatcaattatttgtttattttgaataactagaaaatgattactttgactattgcctccacttggtgcatatcttcctgtttctataattttctctaacaattcttgactaacttctttatctaaatattttcttgtacttcttcttgttattatattttcaaatgtattcattctttgttctatttcctttttcttttataaagaatatatccaataactcctagagctacaacacctgctgtgctactattacccccttgttctttttgttctttgtacttgttatattcttttttatattttttgtctaaaacatcatagactttataatttttatatttacgataatattcatcactttgcttttcattatcaaaatcttcttgcgcatattcagaaagtttcttttttaatgtattaatttctttttcttcttgattataagtactatgataactttctttataaacattcttttgtttttctaaagtatactcactatttgtatcttcatcttctaaatttcttgcattttcgattgcttttttatttgcatcttgtcgtattttagaaaaatcatctgtctcactttgattatacgcttctttataagctgttaaataaatttcactcattaaccctactggaacatttaaattataaacttctgtcattgttccatcagttgttccatttgtcgttccttgttcttttgaaagtgtcgttaattcattttcagcattagtaaatccagtattgtaaccgtttatataagtttgatcttttcccgtaagatcttctttactggcatcaggattagcttttttataattatatccagccgtttctccttgttttgtataatcaatcactttagctgcacttggagtagtactttttgaagatgaactactcgacttagatgaagaactactatttgaactcgatgaagaactacttgatccaccaccattatgataatgatattctccatctctaagtccccattttgcacaatttgttcgacaataatgacctccattagcatctgttctacctggatgtgcacttatcggtgtaatcatcataagtaaaacaacaataatagaagcaatctttgctattctttttttcatatttctattcctttttaattataaaatatattcttttaaacaatttgtataacgtagatatccttcatgattgatatgaagtccatcttcatagtaaacttcaacaggttcaccttttttattacataatattggataagcattaataaaagttacatattcataaggaattgtcttcttaaattccttataaatcatttttaataaatcattacttctcaatacaccaggtgtatgtttataatcatgcattggtaaacatggtaatggtgagaccacataaatttcacattcaggtaaattataatgtacagtttctacaagttctttgacattaatagcaatatctttaggtgattgcataactgtttttcctaaatcattcgtaccaatcatataaacaagttgtttaggtttaaattttaaaattccttcatcaataaaatgaagcagcattgtggaagtaattccaccaataccacaattatatttattttctatttcaggaaaatatttttctatatccataaattgggtgatagaatctccaaaaaagacagtacctccttcctttgcatttttattttgatcaataatttctttcatacgatcaattgtcatttctcttatttgatagtaatttgtaagaaatgtcatattttctctcataatgtcgacctcttttctatataatattattatatttttattgttttattttttcaatgttgaaaaaatattgaatatacttgaaaaaagtgatattttattatcattaatacgaggggagaattattatggtgaaaatcgtcaaatttggtggttcatctcttgcagatgcccatcagtttaaaaaagtcggtgacattatcaaaagtgatccagatcgtcgttttgttgtaccttcagcgcctggtaaacgttttaaagatgatatcaaagttactgatttattatacaaagcatataatgcagaaagtgaacaagaatttgaatgtacttttgatacaatcaaagatcgttatcaaagtattatcgatgaacttaatttaacagttgatcttactgaagaatttgaagttattaagaaaaacttccaagatcaaatcagtgaagaatatgcagcaagtcgtggggaatatttaaatggtatcttacttgcgaattatttagaatttgaatttgttgatcctgcaacatgtatctttatcgatgaacatggaaattatgatgataaaaaaacagatcctgttttatctaaaaaattaagtgaagtagaaaattgtgttattcctggattctatggttcatgtagtgaagatcctacaaaaattagaactttctctcgtgggggaagtgatgttactggttcaatcgtcgctaaatgtggtcaagttaaactttatgaaaactggacagatgtttcaggtttcttagttgctgatccacgtattgttaaaaacccagaagtgattggaacaatcacttataaagaattacgtgaactttcttacatgggagcaagtgttttgcatgaaaatgctgttttccctattcgctctcaaggaattcctattgtaatcaaaaatactaataaacctgaagatgctggaactttaatcgttgaaagtactgtgcataaaccagatcatattattactggtatttctggtaaacaaggttttgcgacaatcatgattgaaaaagatatgatgaatgatgaaattggttttggtagaaaagttttacaagttattgaagaagctggtctatcttatgaacatacaccttctggtattgatacaatgaacgtaattgttgaattaaattcattcattgaacatgaacaagaaattttagctaacttacatcgtgccgttgaacctgattcaattgaacttgaatctgaccttgctttaattgctatcgttggtcgtggtatgaaagatggtcgtggagttgcagcaaaagtttttacagctttagccaataaaaaaatcaatgttaaaatgattgatcaaggttcttcagaattaaatatcattgttggtgttaaaaacattcactttaatgaagcaattcgtgctatctataatacatttatcgaacaagaataaagactttggtctttttctttttatttaattcatataatttctctaggaattatctaaaaaagatgttataatagacaagaggtggtcatatgaaaatatcaacaagagggcgttatgctctaagattaatgattgatttagcccaaaataaagaacaagggaatatatcacttaaagatgttgctaaaagacaagaaatttctatcaaatatcttgaacaaatagctactcctttaattcgtgcaggacttattaaaagcgttagaggtgcccaaggtggatattctcttacaagagatattaataaatatacagcaaaggatattttagttgctgttgaaggtccaatcgcttgtgttgcctgtttagaaactgaacctaatcaatgtcctcgttatagtgaatgtttaactcttcctttttataaaggactaaataaagttattactgattatttagaatcctatactttagaagatcttgctgatttacatggatatcaaattgaatatattatctaataaacatatcattgatatgtttttttatttaaaaatcgtgtatttctacacgattaatcatcataatgttctaaaaacagatgttttccttcatcatctttataagccataattgtttttaaattgacattttctacacttttaaaaatatttccttcaacaaaaggatttactttctttaaatccttaattaattgtttaatttctaaacgtttagaagcattttcttcatcatgagcatcttgattttcttcagtaaatttacatgcacattgtaaaaatgttaattcatgttcatctctccatgccttaatatcatcttcacgaataagatacatcggtctaataagttccatttcttcaaaattcaaactatgaagtttaggcatcattgtttgaatttgtgctccataaagcatacccattaaaatagtttcaataacatcatcatagtgatgtcccaaagcaatcttattacatcctaattcctttgccttcgcatataaatgtccccttctcattctcgcacataaataacaaggagatttttctatattaaaaacagaatcaaatatttgtgaatcaaatatttgaattggaatatttaattttttcgaattatcaataatcatttgtctgtttaattgattatacccaggatccatcaccataaaaacaagttcaaattcaaatttattatgtctttttaattcttgaaagagtttagccatcaacatagaatcttttccaccagaaatacatacagcaattttatctccaggttttactaattcatattgattaatagccttgcaaaaaggtctccataattttttcttatattttttttgaatactcttctctacttcttttaaatactccaaattatccatcttttatcctcactttctctatttataaaaacaaaattcatatctaaagtcaaatattttcaaataattcacataaaaagttcaaattcaattcatattgatatataaaatgatagcgaggtgataattatggctgaaagatttaaattcaacgatgaagaagaaaatatagatgaaaacgataatcaacaagatgatttagaaaaagaatattatgataatactgattattcctatacaaaaagtaaaaataaaaaaagacctaaaacaaaaaaggtaacaagaaagaagacaaaaacgaaagtgaaaaagaaaaaaaatggacgttctaaagtttctactttctttatcacgttacttattttacttttaattattggtgcaggagttggtgggtattttgcatatgaacattatcaagatcaacaaaaacaaattaatcaattagaaaaacaagtagatcaacaaaataaaacaaaatcagacaagtcaacatctacaaaaaaggaaatccaacaagaagaatcttcttcatctgaaaatgaagaaagtacatcaagtgataatacaacaaacagcgatgaaagtgattcatcacaaaatacaaccgatgattcttcatcaaatgaaaatacaaattcagattcaacaactgaaacagaataaaaaaacttggcatttgccaagtttttaaatttgatctaaagcttcttttaaatcaaataagatatcatcaatatgttctgtaccaattgataaacgaattgtattaggttgaattccaacatcagctaattcttcttctgttaattgtgaatgtgtagttgttgctggatggataactaatgatttaacatcagcgacattagcaagtaaagagaatacttgtaaattatcaataaatttatgagcttcttctacgccacctttaatattgaaagtaaagattgatcctccaccatttgggaaatatttttcatataaagcatgatctggatgatctggtaatgaaggatgatttactttttctactgctggatgttgttgtaagaactcaacaacttttttagtattttcattatgacgatcaattcttaaagataatgtttctgtaccttgtaataataagaatgcattgaatggagaaattgtagctcctgtatctcttaataagattgctctaatataagtaacgaaagcagctggtcctgcagcttcagtaaatttcactccatgataacttgggttaggttcactaatccatggataatgtccacttttagcccaatcataagtaccaccatcaacgatgacaccacctaagcttgtaccatggccaccaataaatttagtagcactatgaacaacgatatcagcaccatgttcaattggtctaaatagatatggtgtaccaaatgtattatcaacaacaactggtaatccatgttttttagcgattgcactaattgcatcgatatcaggaatatcactattaggatttcctaaagtttctaaataaattgcttttgtgttttcttgaattgcatcttcaacttcttgtaaattatgagcatctacgaaagtagttgtaattccgtattgagtaaatgtatgcgctaataagttagaagttcccccataaatagttttttgagcaacgatatgttcaccttgtcctgctaaagcttgaatagtataagcgattgcagctgctccagaagcaacagctaaacctgctaccccaccttctaaagcggcaatacgatcttcaaatacaccttgtgtagagtttgttaaacgaccatagatgttccccgcatctgctaattcaaaacgagctgctgcatgtgcactatttttaaacacatatgaagtagtttggtaaataggtactgctcttgcatctgttgctggatctggttgttcttgtcctacatgtaattgtaatgtttcaaatttaaattttctatcttctcttttagttactgccattttaatttcctcatctttcttttgtataaatattatatattgttttatgaataaataaaactatttacacattcgtccattacggaaattatgtcttaattcttcaatcattcaaattcccctatctaatcttgaattaaaggtgttgataaataacgatctccaccatctggtaataagataaaagatttaaaattatcattgttgattgtatgtttatttttatgtgttatcaatgttattttgccatacattactatgattaacacacaagaaataattaatagaattcagatagggttatcaataagacttattttaaaaaggttaataatttttttgattttaggtatcttatatataatttcctcaaatttatataattttcttatattaaagtataaagaatatttatatcttgaattaaataagaaatttcttgataattctttaaaatttaatttaaaagattttgaaaatccagaagtttacaatattattcaaagagccgaacaggaaataggaataagaccttataatataattatttcattattatcgataatttcacaaagtgtcaatttaatatctgcatttttgatattaactaaatggcatttaacattaatcattggttttatattgttagctagttttgcatcaaaatatttcatttcaatcagtaagaatgaatatgatattttaatgaataggacaaactatgagagaaagtcatggtatatttctcatttattaataaaagatgaatatataaaagaagtaagattatttggattatctaaatatttaatacagcaatttatagaattaagaagtcgtttttttaaagaaaatgtagatgtattaaaaaggcaatatatattttctgaaatataccagttaatgaattatgtcatttcattttttattatttttttagcaatatatgagtcaactcaaggaattattctagttgggacagctatgacttatattaatacttcttcaaagattgagaatgctatacagaatatagttagtaatatttttggaatatataaggattctttatatatagataatattaaaaaatattttaattatgaatcaaataaattttatggtaataaaactttaaaaaatataacaactatagagtttgttaatgtttcctttaagtatccaaatagggaagtgtacgctataagaaatacaagttttaaaataaaaaaaggagaaatccttgcaattgtaggggaaaatggttctgggaaaacaactatcataaaattattaaatggattgtatgatgaatatgaaggaaatatattaataaatggaattgaaataagagaaattgataaaaaaagtctaagaaattgtttagcaacattgtttcaagactataacaaatatcaatttacaataaaagaaaatataggatttggatcaattgataacttggatgatattgaaaaaataaaatacagtgcaaaaaagggcggagcagatcaatttataaattgtttacctaataattatactcagcaagttggatactggtttgaaggtggaacccaattatcgggtggtcaatggcaaaaactagggctatcacgtttgtttatgaaaaatgctgactgtttaattctagatgaacctacagcttcattggaccctttttcagaattagaaatatttaaacaactatatcaaaatagtaatgaaaaaataaacattattattacacatagatttattaatactgtatttgcaaataaaataatagttttaaagaatggagagataattgagaaaggaaaacatgatgaattattaaagcaagacggattttataaggatatgtttgatatacaaagtagaggaataacattgaattaattttgtaagaaagtagataaaagtggtatttaaataaaaatgtataaagaagagaggaaaaaatatatggaaaatgtattagttattggagctcatcctgatgatatagaattaggatgcattggcacagtgttaaagctaaaaagtgcaggtaagaaaatcatttatcttgttatgacgaatggaggaaatttggaaaaaaaaacttacatagataggttatgtgaaacaaaaaatgcagtaaatagtgtgaattttgatgaagtaattataggaaatattaaagatggtcatttgcttcataatcccaaaactattgattatttgtcaaatattataaaaaagtatgaaatagatacggtgctatgtcaatattttaaggattctcatcaagatcatgtaaatgtagggttatctgcaatatctatatcttcgatttgtgaaaatctattgttttatgaatccttaactagtactgaatttatacctaatttattcatcgatattagtgattttgaggaacaaaagaaaagtttattaagaaagtatacatcacaaatagaaaaatataaaaagagaaatcaaaatttattatcatacatagaagcaaaggacaaattgaatggaattaaatcatgttccaactattcagaagggttaatgatttataagatgaaaggatgattaaaatgaaacctaaagtagtagcatttacagttaaacatatcagtcatatttttccaataataccacttttaaaatctattgataagtgggcagatttgatatgctatattgataagaaaaatataaatatctttattgataataatttaaattttagggtatatcctgtagatttaggcgatactgattattttgaagaatcgcaacaagaattagaaaaatttgcaatagagttagctaatgagaattatgaaaaagcacattatcattcgttgaaacaagatttaatagcatcacatactattaacaaagagtattttgatttattactgaaagatattaaacaggaaaaagttgatttaattatcagagatactgtagatgtatatggagcagaaattgcaagaatactaaatgttaaaacagttggatatataactaataatctttataatgaggaatacttttctgctcatgaagaggagttacatatttattttgctacattgcctatcgaaaataagctatgtaatgattattatcataatttttttaaaaaaattagaggtatgaataaggaagttgaaaaaaaattaaatgcagtacacgtagattgttatcataattatttattagaagatgattttaatttgatctttagtacgaattatttacaacccaaagaggcaatacctagtgataatattaataattataaaattatttatccaaattttcataaatttgtgattgaagacaatgtgccagaaagattaaaagaatttatttctaaaagtaaatatattatttacgtttctacagggtcttttcattcggaagataaaaaattttataaagcaataattaattattttgctaattcaaaatttaatttggtaatttcttgtttgaagtggaattctgaaattaaagactatattagaagtgaaaatttagattcacaggtttatgttgataattttatcccacaaaaatatgtgttatcgcatgcaaatttatttcttacatcaggaggatttaatagtgtattggaatctatttattatgaggtaccaatgattgttaggcctgtttcatgtgagcaaagaatgaatggaattgttatagaaaaaaataatcttggaataacactatataaaaaaaataaaagatccttacgtgatgaagtatattttttattgaataataaagaaatagaaaatagtttaaaaatgaattcaaaagatttaaaaaatcattttgataataattatgagacaataaataagagaataaggagattgattaatggttaaagtatttatatttaatggcagcttgaatagaaattctacaactgactatttaataaaaaattttttaaataagttaaaacaaaatagtgacattgaattaagtacatattacttgaaaaataaagagattagtaattgcataggttgtagtagatgttttcaaaataaagaatgtgtattggacgataaggattgttttgataaggttagagcagaaatgttggattcagatattattataataggaacaccgatatatgcaaacaatgttactggatactgtaaaacatttatagatagaatatcgtcatggtgtcatatttttaaattaataggtaaaagaggagtcattattactacaacaagtaattctggattggatgaagtaaataattatttatataaagtgatgtcatacttgggattggcggatattgaagtaatatctcaccaattaaataaagataatattaatagaacgcttgatgaaatagattatatttcctctaagctaataaataatattaaaaataatgaaaaattaaaattttctaaacttagtgaggaatcttttgaaagattgaaagaattttatctttcggaaaatgcaaatattaatgaaaaaaaatattgggaagaaacgggaatgattacatgtgaatcgttagataaaattatttatgaaaggaggtgaagaaaatgtcaaatttagatgaatttgatttgaatccggttgttaatgtagaagataataactctattgaaccacattcagttatgtctgttttaccgactatttcaataacaattaatccaccaacttctacatatacgacaaatccaggatacacagaatcaaaatgttaataataaaatgaaaggagtgtaattccatcatcatgtctatctacataaatgaatccataacgttttgcatattgtcctgttccagctgatactaaatcaattggtccccaagtaatataaccaattaatggtacgccaccttcaatagcttctttcattgacgaaaatatgttatcaaagaatacgagagctaatgattattatctttttttaattcaattgatttcacatcctcaactaatctaagtttatgaataactaaagtttcactaaaatattatctttccctttttttaattcattgaatcaacaccataagttattcccaaaaaatgaatatttttttaaaatcgagaatagaataatgacaggttacatttattatgctagtatacatttgtatatgataataccgaaaaataaaaaaaattaaaaaaatggtaataggagataacaacatgcaacttattgttagaaaaaaatatttagatgagctgattgaattatatgggacacctgatataaaagtaatcacaggtattagacgaagcggaaaatcagtattacttcaagagtttgtcacttacttgcaatcattacaggaacaggtgaatattgtaatgataaacctgcaagaattagagtttgatcagttattagagtaccatgaattgcataaatacattttgaatcagtacaaagagggtatgccaaatgttttattgatcgatgaagttcaattatgtcctcaatttgaacttgcaatcaatagcatttatgtaaaaagaatctacgatatttatatcactagttcaaatgcatttttactaagttcggatctagcaacactttttactggaagaacaatggaaatacaggtatatccattttcttttgtagaatatctcacttactacaaaatcacaaaagaatatgatgaagcttttgatcagtatgtacgaactggtggtatgcctggagcttatgtatataagactgaaaacagacaatatgactatgttagagacgtatattcaactatccttataagagatttggttgaaaaatataagatcagaaataaatcagaatttaccaacatctctgaatttatgatggataatattggtaacttgctttctccaaataatatttgtagaaccttaaataatagtcaaagcgaaataaccagaaaaacagtatcaaaatacattagctatttagaaaatgcttttcttttctatgaagcaaaacgctatgacttaaaaggaaaaaaatatctaacgaataatagcaaatattatctttgtgattcatcatttcgttatgcagttaatggtacaagaaacatggactttggaagagtttatgaaaatattgtttatttagagttacgtagaagaggatatgaagtatatgtgggaaaactttataaaaaagaaatagattttgtagccaagaaacgtgaaacacaactatatattcaagtgagtgataatatttcgaatgaaaaaacatttgaaagagaatattctccactacttgccataagagatgcatatcctaaaatgataattgcaagaacatatcatgaaacttatgactataaaggtgtgaaagttgttgatatttgcagatggttacgagaatgttagcaatttttaacaaaataaagaatatatagaaaaaagatgaacatagggggtaatttcattatatattaatcatctaattgcttacaaaatgatttcatcatcttttctatatttctatcaaaaaattggacggtgccaaagcatcgtccttttattatattaaatttcttctccgttagattcacaaacttttttataccaatagaatgaatcctttttacttctagagattccatcatcatgtctatctacataaatgaatccataacgttttgcatattgtccagtacctgctgatactaaatcaattggtccccaagtagtatatccaattaatggtacaccatcttcaatagattctttcattgcatggatatgtcctttgaagtaatcaatacgataatcatcatgaattgatccatcttcttctactgtatcaaatgctccaaaaccattttctacaatcattaatggagtatgtggataacgatcatgtaataagtttaatgtatatcttaaaccatctggatcgatttgccatccccagtcagatgcttttaaatatgggtttttagcaccttttgacatattacctgcagtagtttcagcattttcatcaacagttacacaatttgacatgtaatatgagaatgtatagaaatcaactgtaccttctttaataatcttcttatcttcttctgtaatataagaagtatcaatattatgttctttaaaatatctgaagataaatgatggatattctccacgtacttgtacatctccacagaaattgtttttaaagttatcttcatcaaaagcagctaagatatcttttggatttggtgtaagtggatataatgttgtatgtgcaatcatgttaccaatcatgaaatttggattgatcttatgaccttcaataacagttttagcacttgctacaaattcattgtgtaatgcttcaaacataatttgttcatttgattttaattcatttaatggaattctatgatctgcattaacatcttctggatccattaacccaagtccataaaggttaccaattccaccttcacccatacatgcaatattgatttcgttgaatgttaaccaatatttaactttatctttataacgtttcatacatgttgtagcgtatttcacaaacatatcgatgactctacgatcagagaaaccattatattttgtaacaatgttccatggaatttcataatgacataaagtaactaatggttccataccgtgtttatgacattcatcaaatactttgtcatagaaagctaaacctgcttcatttggttcttcatcatcgccatttgggaaaatacgtccccagttaattgataatctgaatactttccatcccatttcagcaaataaagcaatgtcttctttataatgatgatagaaatctaccgcttcatgactaggataaaaagcttctggatctgtttttggtaagaatgttcttggtgtattaacatctccacctaataacatatctggtaccgataaacctttaccatcttctaaatatgcaccttcacattggttggcagctactgctccaccccataaaaaccctttaggaaatcccattttcattacctccttgtttccatttgatttttctataaacattataaaggaaaatcatttaaatttctttcataatatgaaaaactattcaacatttttccaccaatgttcttgataagtttctatatgactataatcgacaatctccccaatctttggtgtcgccacatttaagttttctttttgtgatcttgtggtaatttgtttaattggatcatcccaagcatgattacaaatacaaaaagcaccccaatgaacaggaactgtccatttagcatgtagatctttcattgcttgaatgccagctttgggtaacatatgaatattggaccatgctcgatcatactgtccatcttcaatcattaataaatcaatagcgccaaatttttcataaacttcttcgaaatgatttccataaccggtatcccctgtaaaataagttgtatatttatcatttttaaagacatagccactccacaatgtcgtattgtttctccaaggaacacgtccagtaaaatgtcttcctggtgttgaagtaattgtgagtccgtctatttttacttcatcccaccaattcatgacatgaatcttattttcatcaattccccaacgaagtaaatgtttttctactcctaaaggaacacaatagacttttacttttttatcaatttgtttaattgtttgataatctaaatgatcataatgatcatgagatagagctaaaacatcaatcattggcatgttttctatatcaataggtaatttagaaaaacgcttaggtccaataaaaggtacaggagatgcataatctgaaaacacaggatccattaatacattcttcccttctatttgtaataaagaacttgaatgaccaaaccatatccatttaagttcatcgttcttcgctttttctattttctttaactgatgaacaggtatttcacctttaggaactgtttcttcatttttatattcactcttttgtcccgtcatcagttgaatttcaggatttccatgaaatattccttttttatataaagagtttcttgctttataattcttttcatcttccttattaacatttcctcctaaactaggccaaaacttaataaacaacaaagcaataactccaatacataaaatgacaatccctattatttttaataccttctttatcattttttactccatataaagtgtaacagttacacttcctttccctatcgcttcttttaaatgtgttgtatctttaatatgacctaattttgtaaaatcccatgtattttgattataataaagacataatttattacctaaatataaaataatatctccctcttttgtagttattgtctcatcattacgaggtaatgatgtgcctaaatctcctactttttcaaagtttccataatcatctaaagaaagtactcttttttctttagaaacatattctttaaatgcttttgcacttgtattgttttctaactctatttcaaatgtataaccattaacttctaatttcattatttctcttccccattctttttctatacttttttgatgaattggtttatttgcaaaaagaaataaacctgcaattataacgaatactaaaataatccttttcattattgtatcgctcttcccatttcataagctttctttaaggcaggatgatctttaatactattaggaatatcaacaccacctgcaaatacacttcctacaaagtgggctttaggataacaattaacccatcctttcaaaccattgatagcacgtttatctaccccttcttcattttcagcagctgttgagagtaaataaacatctctaaattgataattagatgtataaagagaattagctcgatcaatcatgactttcatttgtcctgacatttcataataataaataggtgttgcccatacaataacatctgcttgtttaattttttcagtaataatattagcatcatcatctattacacaatgtcccaatttttgacaacctaaacaccctttacaaaaagcaatctttttatcttttaaactgatttctattacatcattgccactttcttttgcgctttgaataaaagcatcagcaagttgatcagaattactatttaatcttaaacttgttttaataacacatatttttttagccatcttcttttcctccatttgaatattattatattctatgataaattaatagtaatacctaaacttaactttaggtcaagaggaggaactaaaaatgtattctattggtgaaatatcaaaaatgtttgacttacctatttctacattacgttactatgataaagaaggtttatttcctcatttaaaaagagtaaatggggtaagaaaatttagtgaaaatgaaatagaaaccttacgtgtaattgattgtttaaaaagatctggtttagaaatcaaagatattaaagaatatatgaacctatgttctttaggaaattctactttaaaacaaagaaaagaaatctttgttaaacaaaaagaagaagtattacaagaaatggaaaaacttcaaaaagtactttcaatgcttaattataaatgttggtattatgatcaagccattgaaaaagaagatgaaggttatgttcaagctctttcttttgaacaacttccaccacaaattcaacaatactatcaatatagtcatgaggattgttagagatgaaaaagaaaatattaatgacactatccatcattttaattctttgtatgggtggttttggcatttatgtcaatgattattctcacgcacaaaacgatgccctagaaattttaaatcataaaaatgtggaaaaagtaaattcaaatcttattacactaactcctgaaaagaaaagtgatgtaggtattatcttttatcctggagccaaagtagaaaatacagcctatttgcctttattagaacaaataacaaacaaaggctataactgttatttattaaagatgccttttaacatggctatctttaataaaaatgcagctaataaaattattaatcaatatccaaatataaaacattggtacatatgtggtcattcaatgggtggagccatggcttcttcctatgtttctaaaaataaagataaagtagatggtttaattctattgggttcttatatttatggagatgtatcagataaagatgcacttactatttatggttctttaaatacaagtgttaaaaagaaaattgattataaaagaaatatcgttgtcattaaagatggaaatcatgcaaactttggtaactatggtcatcaaaaaggtgtgctaaagcaactatttcacgtaaagagcaacaaaaccaaactgtaaaagctatcaataatttcattgaaaaacggctgaattaattttcagtcgtttttacataatcatttaaatgaataccattcttcaaggcatcaataacatgattcttatcgataacattttctaccttttcatctaaaatcattccaataaaacgtgcatcatcatcaatagtaaaaggccaatagaagtagaagtgatttccatctttaaattcaaaacgataatcaagaacataccaatctctcgcaatcggtgttccataattttcataacgatgttttaaaagaagttctacactttgaatatcttcatatttatattcctttataaatttatcttctttacccaataaaacagaataaaaatattttacattatctatataacctttaaattgataataacgaatacgatcatttaaaaactctaccgattgatttcttgtttgatcaagtggtaatcttaaccataattgtgaaaactggaaatcagcagcaataaaaccagttgtaattaataatgaaataaaaatcacaaatattattttttgtacagttgttgtagatggtgcactaatgaatagtacaattaataatgttggtataaatttatataagaattttttaatagcaagtttctttgtaagtcttcttccaagagatacaatatctgttgttttttgataacctaatttataattcttcacttctctttggatttgttgtaaagctggtaacattggtagatcttttcttacatatttccctctttttctgcctttatatcaacgtttttttcattgatcttttttgatgtttttttatgatttggtgtttacaaactattttgagtatcaaaaacagcaaattttatataccctttatttgtttttttataaaaatgcaaaagaatcaaattaaaatttgactcttttatagcatacttttattattatcttcctattaaataatcattaagatttattccttgtttcattgcataaagaatattataaggatcttcaatatattctactttcttttctacaattgtcgcaatatatcttgcatcatcatttaaaatcattggccaatagaaatagaatgtttgtccatctttaaatgtgaatttaaaatcagaaacataagtttcataagccaatggacttcctgtactcatatattttttcttagcaataacttcaagttttttaatatcttcatataaacatttatgcataaattgatgttttttattaaaaacaaccgcaaagaaatatttgaaattacttattggtccattaaattgataataataaataccatcacttaaaaattctacagattgattaagtatattatctaacatcatcgctgatgtttgtttaaaagaaaatgctatcattaacataaatgtaactataaaaaatacaatgcctactaaaactctcatatttcctaaatcataaggcattctagaaaatgacacagcaactacaagtgctcctataaaagtaataattaattgtcttcttgcaagttctggtgtaagttttcttcctaatgaaactgttgaagtcgttttttgaaaacctaatcccattttattattattatttttaatttcacttaattcttctattaaaggtagatctttatcataataatcatctattgtatctttaatttcattcatactttctatttgtttttgcatgttcacttgattgatttttaaacaatgcctaaaatctaattcaccgtctaagatagctttaatatcatcaacagatatttgaagatttcttaaaaatttaataattttcaacttttgaactgtttcatcgtcataatcacgataaccattttcttctcttttaggttgaataagcccctccttttcataatatcgaattgtgtactttgaaagaccaatttctttttctaattcatttgttttcatattacctttcctcctttcaacatcattgaacactatggagtggctccacagtcaatatttattgtaaaataattcaataaaatactctatttacataaatttaataacaatctctttaaattttctttgtcacatatcttttacttcttttatattttaaacaatacacttatcttattaacaaatcatatatttcaacttaataaaccatatgacgcatctttttaaataagatttgaattcataaaatttaaaccttaattttataagcaaaattatggcttttacatgtacataacttgacacctaatcaccacctgtttcagatggtcaattaagtatttcaataagaatagcatttatctaattatacattagaattattgttttttattgttttacaaaatattctctataaaagaaaaaactagtaaatcaaaattgatttacgagttaaagaacaaaaaaagggtttcttctatcttgaaacccttttttatttagcatatttttcgctagattaagctacgttagtatgtaatggaattagtgtaagtacttcatcaaagacatatgattcaactttagatgaaaaggcaaaagaatttgcaaagttacttaaattaaataaaaaaagcaatgtgattggatatacaattattaaatcattattaagtagtaatggagatccaaatagatccgcaaaaggatgcgatacttctacaagattaacaattgatcaaattaatcttattaaaaattctggatatactcatgtagggcgctatttaactaataccccgggtggaacattggataaaaaattaacaagaacagaatataagaatattgttaatgcaggattaaatttattctttatttttcaagaatatggaaataaagcaagtaaatttactttgaactctggaacagaacatgctaatagagcacttaatgcagctttatctttaggagttcccaaaaacgcagtaatttattttgcagttgattttgatgcaacagattctgaaatttcgaaaaatattattccatattttacagcaattagaaattcagaatgttcgtcatattataatataggtgtttatggaacaagaaacgtatgttctagaattaaaaaatctgtaggctttgacttttattttgtatcagatgcatcgtatggatttagtggaaatttaggatatacaatgcctgattcatgggcatttgatcaattcaaaacagatattactttatcaaatagtacaacatctgtaaatattgataaggttgctgtttcatataaagataatggcgtttcaaacatgaaaattacaacagaaaatgttgtgaaaaattttttatctgcacttaaaatgtctgatttatttaatgtaaaaattgattatgaaaaagaccaattagtttttttacaaggtccggattcaattggtaattacatttctttacaattaaaacatgatgtttcttatgatagttcagcaagcgggactttaaatattgtagagggggaaattaagggatcatctttagatgatttaactgttgacttaaaagttaatgatgatgtaaaagctgaaataaaagcctcagtaaaagaggtagtggttacaattaatcatggttctttaagctttagtactcaaaatgttgcagatagatattctaaaggagcaatttatgtttatactattacagctccagtaattgatgataaaggattaactagccatgttaaattaattttaactgtaaaagtagcacaagatccacaattggattttgcatatgatactttatcagaaaaagatatggctatagcgagagctttttatacagttgcaattatatttggtttatctgtaacgacaagtgtaggactttcacttattggtaaagtattggaaggatatggccttcctcaaacaccaatagccgtatttaaactttgtaaactaattgctagttaatatagaaagtggttatttgttaatagccacttttttattgttaggataaagatttaatgaagatgtttaaataataaaaatatttacttttgttgataatatagataaatagtattagtatactttatataagaaggagagaatgatgctatgaaaaatgaaattatatttagttatagattgataaagttaatatattatttaattgcgctatatgttgcaataacctatgtaaatgaaataagcaaagcaatatgctatattttaattttggtattgattttaggatgtgctatgtatatatatttaataatagtttataaaatttatagtaaaagtataaatttggaaaaaaatataaaaaaagtaaatgatgcgatatgtaaaataaaaggaacattgattaatagttatttaaagaaattatattgtgatttattagaagcatcaaatcatacagatgaattttatgatttttttgaaaaaaataaagatttaatttttggagaaaagagctatgctttttggtatacaacaaaattattatactattatgatcgacaagagtataataattatttagaactatataattctaaattaaatagtaaaataaatagtaacctttctgaaattatatactatattataagcgaagaatatgatcaagctttggaattattgaagaaagcgataaaaggacaaaagggattggggtacattatgtgcctatactataaaattatatgtttagaaaagttagatagagaagttgaattaaatgaagctgttggagaaatctcaaaatatagtagtgaaattaaatatgttaaaaagataaaagaaaaatatttggctgattaatggtaagcagcaaataaaatagtggatagaagtatagtaaatcatcaataatgattatagtagttttagaaaactaaaattactatattaagttcccaattttactatacgatgatggtgagattatgaatgtttagagttatgcaatcatcagaatgtggatttaatgaaaaatatccaagggtgcataatggacgttagtatgtaatggaattagtgtaagtacttcatcaaagacatatgattcaacgttagatgcaaaagcaaaagaatttgcaaagttacttaaattaaataaaaaaagtaatgtgattgattatacaatcatcaaatcattgttaagtagtaatggagatccaaatagatctgcaaaaggatgcgatacggcaacaaaattaactaaagcacaaattcgaactattaaaaatgcaggatatgaatatgtaggaagatacttatcaaatacaccaggaggaacattagataaagcattaacaaaaacagaagtcaaaaatattttaaatgcgggacttaaattatttgctatttttcaagaaacaggtagttcagcaaaaaattttacttcatctacaggtaaaacaaatggtcaaaaggcatatgatgctgctaatgaattagatattattcacggatcaactatttattttgcagtagattttgatccaactgatagtgttattaaatcaaatatcatcccttattttgaatctattttatcatcctatgcagctagaaaatataaaataggggtttatggaacaagaaatgtttgtcataaattaagaaatcaattaggcattaataagttctttgtttcagatgcatcatatggattcagtggtaatttaggatatatcatgcccgatggatggtgttttgatcaatttaaaacagatattacaattggatcagatgacggaaaagtttcaattgataaagttgctgtttctaatagagataaaggaattgaatacacaaaaactgacatgttaaatgtcattatggactttgtatctccgtttgatttatgtgatagagtgaactgttcccttgattatgaagtagatagtttaacttttttaaagccagatacagcagatgatagaaattatataactttaagcgtgaaacatggggtttcatttgacccagatgaaggtgttgcgattacgaataatggggaagaattctctttggaacttgataaatatttgaatgcaggttacttaaaaaatgttgataatgatactaaaacaaaaatcaaatgggctactggaaaaattgggtatagtgtaacaacaggaaatcttgaaacatcagtaatgtcagtttcagatagagataattcaggtgttatcatttcatatgatttaactattccagaaacatctgatgaaaaaagatatgtaaaaattagtttaatgtttaaagtttgtggaccgattaaattcgatttttcaatgataaaagttactaaaaaacaaaaattggctttagcgggaatgggacttgcttttgcggcggtaattctattaccaggtattgctattcctttaggaagtggattaggtttaactggagcagaagggcttgcaacgactgaaattatttcagaaggctatcattctgtatatactagtttaggatttatctaagaagaaaaaatattttctatatttatttaaatatagaaaatatttctttttttattatagctatgtaatttaattaatttttagtatagaataaatatagattagtattattatagaaaaaatgtaatcgattactgataatcaagatagatagaaaggaatatatattgtagagaaaattaggtaattcagctaattacaatatactaaggtaaatatgataataggtattttatttattataaaaggtgcatttaatatattgaaaggaataaactacttcattttcaaagataattttaaaatgattcctatggaattaacatctgtatataaatcacctgttagtactcatgaaattacgtatatatattgttatcaatcgattcatcaaggaacgaatgtaaaatataaaaccaaaggacatggttataaaaaagaagtaggagatattgatttcttttattatgatgaaagattacatattgtttatgaagatgaagaatatgttgtttctcatatgattttaggagcttttttatttttatttggattaagaataatttttttgtacatataaaagaggatatgatattttatatttaatgcaaaaaaagattgtaggacagtatctacaatcttttttgttctataatgagaacatgaaataatatgacatttatcaattgtatttatatacaaagatgataaaatgaagtcacaagggggatttgtatggaaaaagaattgaattgggcagtcataggaacaggtgtgattgctaatgaaatggcacaagctttacaaaggatggataaaacactttatggagttgctaatagaacacaggcaaaagctattgattttgcaaagaagtatggtgttaaaaaagtctatgatgaaattgatgaagtgtttgatgatgaaaatgttgatattatttatttggcaacatcacataatacgcattatcaatttataaaaaaggcgttagaacatggaaagcatttatttgtagaaaaatcaattacgttaaatagtcgcgaattagatgaaatgatagcacttgctaaagagaaaaatttaattcttgcagaagccatgaccatttggcatatgccaatctataaagaattatggaaaatcgtgcaaagcggtgaacttggtaaaatgcaaatcatgacagtaaactttggaagttttaaagaatatgatatgaataatcgtttctttaatatgaatcttgctggtggggctttattagatattggggtctatgctctttctgcagtacgtagttttatgtctaaacagccaaatgaaattgtaagtcaagtgaagtttgcacctacaggctctgatgaacaagcaacgattttacttaaaaatgaagatcaacaaatggcaacgattgctttatcaatgcattcaaaacaacctaaaagaattatgatttctttagaaaaagggtatattgaagtttatgaatttcctcgtggacaaaaagcaacgattgtggatgctgtaacaggaaaacaaacagttattgaaaaaggaaatactgaaaaggcactttattatgaaatgtgtgatatggaagaagcagttagaaatcaagatgattcacatttaaatttagagtatacaaaggatgtcatggatattatgagtcaacttcgtaaagaatggaaaatgcaatatccaggagaaaaatggtaaggacaaattttttgtccttttctttatgcaatgataaaataaagtaaataaaggaggatcattatggataaagtattaaaatttttaaaagacgcagaaacttattatttagcaacagtagaaggtgatcaaccaagagtaagaccctttggaacagtacatgtttttgaaggaaagctttatattcaaacaggaaaagtcaaagatgtttctaaacaacttcatcaaaatcctaaagcagaaatttgtgcttttaaaaatggagaatggttacgagtaagtggaaaattaatcgaagatgatcgtaatgaagcaagacaatctatgttagatgcttatccaagtttacaaaagatgtataaagcagatgatggcaatacggaagttttctattttgaaaatgctacagctattttctcatcatttactcacgaaccacaaattattaatttttaatcataagttacctattaaaaaagctgtaatttttatataaatggacaaataagataaattgtcaatatatggatagataaagaggattatgcattgttgttgatatttcatttaatataatagaattagataaaagaaaggatgaaatatctatgttaaagaatgaaaaaggacaagcagttgcaccaaaaacagtcacaatgacaaaaaaagattttgaagatcaagggaacacccgtgtttattggttaggtggcggaggagccatgatcaatgatcatggaacagtgattatgattgatccccttttagaaggctttgatatgcccttattgattgatatgccaattgatgtaaaagatgtaccgcatgtggatgctattttagtatctcatgtagataatgatcattattcaagaccaacgtgtagagatttaaaagatgtttgtaaagaatatcatacttcttattatgttgcttctttaatgaaagaagaatgtggtttggatggaattggacatgatattggagatcatattcaaattaatgatattgatgttgaacttacacctgctgatcatgcttggcaaaaccaagtcgcaaaatataattatcgtatatgggaagatcgtgaatattgtggtttctatgtaaaaacaccaacaaaaaagatttggtatgtaggagattctaaattgatggactgtcaattacatatggacccgccagatgttatgttctttgattttgcagataatcctgtgcacattggtttagaaaatgcctataaacttgccaatacttatccaaatacaaaacttgttttaattcattggggaagtgttgatgcacctgaagcaagtgcttttaatggaaatccacaagatattttagacaatgtcgttaatcctgaaagagttgttattttagcaccgggtgaagaatatgttgttgattaagaagtagaaatcatgaaatacagtgaagttaaagattttaattatgatgattgttttaaacttagatgtttaattgttgaaaaacatgacaaacataaagaaccatttacgattagaatttatatggatgatcttattatctttcaatatatcatgcaaagatgaaggaaatgtttctcgtggtagaacccttctttgtacaaagcaaagtgagtgttgttttaggtatcaagctaagttatggttataaagatttatgttttagctttaaaatcatcacttcatcaacaaatgctacttgcttggaaaaaggaacaattttttttaccagcaacaactgtttttatcaaatgtgtaagagaatactttaagagatgatagaaatatcatctattttaatacctaaaaggtatcgttattgataaattataagtattagatatttaaaataaagcgaattataataaagatgtaaagaaagagtgatacgaataacaattgaagaagcaagtaaaaaatataatattccaattcatatccttaaagaatatgaaagttggggattgtgtcaagaagttaaaaaagtaatgggatcttggcaatatgatgaaacagacttaaaaatattaagtttgattatgacattatacgatttagatttttcggtttaagaaatagaaaaatatatgaaactttctttaaaaaagaatgaaaatgaatgtttaaaactattaaataaaaaaagaaaaggaatcttagatgaagttcatctaaaagaaaaacaattatccagaattgattatttaagatatgaaatggatcggggaaataagaaatgaaaaagatttgtacattgatgtaacctttacttttagtttttacctgtagtgcctgtagtagtaaaaaagcaaccgctaaaaagaaaacaaaacacaaacagatttaaaggaagccaattcaaaatcattagttatttatttctcttggtttggaagtactcaaaatattgtcaaggaaatacaaaaacaaaccaattcagacatctttgaaatcatcccagaagtagcttatagtgatgactatgatacggttgttgatgatgcgaaaaaggaataacaagaaaaagcaagaccaaagattaaaaatagagttgaaaatattgatgaatacgaaaccatttacgtaggatatccaaactggtggggagatatgcctatgattctttatacattctttgatgattataatttatctaacagaacgattgcaccattttgtacaagtggtgaaagtagattgttagatactgaaaaaacaattcaagtagtggtacagtggtaaaaggattgcacgtttcaaagtcagcattaaaagaggattcaaacgatgtaaaagaatgggtaaatgaaattaaataaaaggagagaagaaggatgaatttatatgcaacagataaagaatataaagaaagatttgattattttttagaagaagttaaaaatgatgaaggaaataaattagatgaacctactcgttatttagctatcttatccgttttaatgggaaaccaaggaatttgtgcttatgaagaagttcttgaaaaagctttagatgttttatcacctatacaagttaaagaaatggtttatcaagcaactgactatttaggatatggaagaatgctcgaatttttaaaagttacaaatgaagtatttaataaaaaaggaatcgaacttccattacagtcacaaacaacaacgacaattgaaaatagattagaaaaaggaatccaagcacaagtagatatctttggtgaacatatgaatgaagcttggaaaaaagcaacagttaataaatggttagcttctaactgctttggtgattactatacaagaacaggtctagatttaaaacaaagagaaatgattactttttgtttcttatatggacaaggtgattgtgttcctcaagttatggcccatattcaaggaaacttaaatttaggaaatgataaagctttccttacaaatgttgttttacaatgtgttccatatatgggatatcctcgtagcttaaatgcacttgcttgtattaataaagtagaagactaaatattgaatatttgtggtattgcaaagcaataccacttttcatatatagaggggtgggaaaacgatggaaactattgtattacaaggaagtttaccagtaaatgatcaatgaatatcctctgaaaactttatcaagtgagcaaatgaaaagaggtatgaagtaagaagctttaaggtttcgaaaatgaatattaaaccttgttttggctgggctgccaaatcattattacgtaatgatttctttatggataaatataggattttataacaaaaaaagggtttagctgaacccttattcaatttctatccaatatctttgaattgttttaccatctttaacaatttcattttctaaaatggcaccattgtttttaattgattttgcagaaccaatattatctttatcacaaacaagtaatactttatcaatatttaacttttgacattcttttaaagctaaaccgatgattttagttgcataaccttttcttctttcattgggtcttaccccatctccaatatgtccaccataatttaataaataatcattaagttcatgacgaatgttgacggctccaaccattttgtttctttctacatctaaggcgaaaaatgttgaatcttctagcaaaccaggttttggattttttaaatcaagattattaatataataatcaaaattatgataatcatttttaaaaatagaagctggagaagtattagcttcagaatgattattattataatcaatccactccttcaacatatcaacaattaaatcttgatattcatttgatgcttttactaatttaatagacataatataatctccttttattgaaatatttctattattataacatttgtagaacataataaaaccctttattaagttgtacttaatagagggaaagtgcgtattatctattttattaaatattttaataaatctttaattgtgacaatgccataaaaacattggttttttaaaacaataatatcttcataaaaatgtgaatgttcattttcaagaaaaagttgacaaacatttttaataggaagatgtgatggaacaatcaaagaatctttaaaaagattaggttcaacaatatctaaatcacaaagtatattttctctttttaaataacctaaataatgtccttcatcattgataacataaattctttgagtggtattattttcttcaaaaatttgataagcattatttatattttgataagtttttaatgtacaagggaaatgacaaagaaaatctattgtaggaatatctaatgttttcttatatttgttgtataattttttgatagtttctttgatagctggtaaaagatcatcaaaattatcaacaggtttctttaaataataaccttgaccatattcaatacctaattgaattaaacattcaagttcttcctttgtttcaataccttcaacaattaatttataatgcatagctttacaatagttgaccatgacttctaccattgtacgcttatctttatttaaatgaatatcttgaataagttctttatctaatttgatatattcaggttgtgtatgattgattctatttaaattagaataacctgaaccaacatcatcaatagcaatttcaaaaccttgactacgataatgtctaacggcttgtttaaataaatgtttatcctcaatagaagttgtttccgataattcaaagacaatattattagaatctaaatggtatttttttaaatattcttttgtaaatccttgaacaaaatctgaatctaataaaatattagcatctacattaataaataactttttacctaaaggcatttgttgacttgctttaatagcacatttacgacatagttgatctaatttccatgattgttcaagtgtattggcaatcttgaataattcttcaatattaagagtacatgattctaaagtgatacggcttaaggcttcaaaagatactatttctcctgtttttaaggaaacaataggttgaaaaacactttttattttcttttcattaattattttaaaaaattcattgattttcttttcgtttaatttcatttatctatcctctattctttttaaaatatatagaaagaagaatgatatttctatcaataaaaactaaggaaattgtaaaaaataggtaaaaagattttgttataataaaacaaaggagaaagcatatgaaagaaatagaatataaagtactaggtgtagatgatttagaattattagtaaagataagaataaaagatttaaaaatgttttctaatcaaaaaataacaaattctacaatagaaaacattagagttttttataaagaaaaaatgttaaaagatgaatgtcatacattggtgggctatcatttaaatcaaattatttcaacagctacaatttactattatgatatccttccaagtaatgaaaattccaaaggaaaagttggacaaataacgaatgtttgggtagatgaaaattatcgacatttagggattggtagatatatggtagaatatcttattgaaaattatcaaaaagatgttggaatgatttgtttgaatagttcaaaagagggaataaacatgtatttacatcttggatttaaaaagaaagataattatttgatttataagaatggatagtgttgaataatattatttacaataactatttttctttataaaattggacgagaagtaagtataccgttgccaatatgcggaataaaaatggttgtaagtagtaatccttcactattgagtgagggtttttattttataaaaaaaggaacattaattttgttcctttaagctttctttatagcttcttccaataggaagatgtgtttgttcttttaaaataacttcttgatttttaatttcttgaataaatcttttgttaataatgtatgatttatgaatttgaataaaatcaggagattgtatttctttaataaattgacttaatgtttttctttcaatcatttctccattaatagaatgaataataatttgatgtctaagtgattcgatataatagatttgtgataatcttatttttgaagtaattccatttctttgataaagataatattgaaagtttttttgaatttgtttttgaataaaatcatgataatgaataaattgcttttctaattcattattaatgaaataaagatgtgtttgcatttgtaaacaaatgcttacaagatcaaaatctttaggtccaataatataaataagtgtactatctaatttcttaagatgatttaaaatatttaaatcattctttttttctatttctacaaaataaatatcttgaattgtttgatgcgtataattcgtaagtttatattctatttgtaaatcattaaagaattgttgaataagtggttctatttgtttgtaatgttttgaaataagagaaattctaatcatgttttttctccttttcaatagctacaatatattgatcaagatttttatttgaacatatgatatctaataaatgataagaatcaacaaaacgtacaccattttttttcattaattcaatacccttattaaaagagtctctatcatgacttacaaaattttcaatgatatattgagaaccatccaacatattaaatttaaaaacaattttatatcctgaaccatcaattaaatatctagatggataaaaagaataacgataataagatatttgtacaaaatcaatttgtgaaagttttaaattgatttgatatctaggatatttatttctaaaaagaaaagaataaagaaattttgttttatctagatttttatcaaaataaatatattttaaagagttttcatctacttcccacattgtattcgtaaaagttaatccaggaagtaccaagatataaatggataataaaataattataagaactattgaaaacatgattctttcataaaaatgtttatacatgataaagaaaacacctaaccaccaaacaacaaaaagtaaaataacaaagtttaataagatgatttttcttttctttatttttccaaccgtaactttcataacttcctcctattttgtattataacatattcttttctcttttcttttgtcgttgatgtcacaataggtgttgttggtgcctttcttctatttgtttaatctaataaaagtatgataaagatagaaaataaataaaaattacacaaatattcaaaaaatacttgagtataaacctactctatagtctacattgagggtgtagggaaaagaaagaagggaaaagatatatgattggttttacttttaaatatttctttaaagagatgaagaagaatataagtatgattggtgttgtttcaagtgcattgttattattaagcctaatattaaatatgttttataacaccgttttaaatccgcctttgaatccaaatgatttagctgctttttttgttggacttctaagatttactatcattatgttgtttatgttgatgtgtatttatttagtgatttattcaataaattattataataaagtacattctagaattttaggtctattgaaaatttttggaaatacaacatatgaaatagttatattttttactttgcaaattgttattattcttttaatttcatttttggtatttacattattgaatattgttgttacgcctttattatttaaattaatttcatactatataaaaaaaacagtgactacaattttatttggtaaagcgtatttagatactttagcatttttctttttaacgatattagttattatctttgttgaatttagatatattattcaaacaccaactactcatttaataaaaggtgatgaagttatttcttataaaataaagtcaaaaaatttgtttaaagaaatattatactttttactattatgttatggcttatttattattgttacctcaaaattagaattagatttagtagtgccactatcattatgcgttataggaattaatgggattattaaatatactattccgagaattgttcaaacagttatccaacaaaataatatgagtggagaattgttggttgttttgaaaaattatatatttattataaatcaaatgggagtacttgtttttttaagtgtattgattaatttagttatgccattaatgatatatatgtatatgaataaagtaggattctttcttggatttgtaatgatgtacattttcacaaatcttattttaaattatatcatttatcaaagactcagcataagaaggatagataataaaaaatcttatactaaattgtatacgttgggctatgatttaaaatcaataaaaaaatatacgaaaatagaaaatacgttattttttttaactctatttattggtatagctatctatttttttactttatcaatttcattgattttaaaaaatgcgattccaccaacagcaatattcgtttgtttaatttatatcattccaatgtttgttattctagttataacaaattataaagaagggagaagtgtattatcatggaagaaatcataaaaacagaaatgcttacaaaaatttataatccatttagtcaaaatcctaaattggctttagatgaagtttctttaagtgtaaaggaaggcgagtttattagttttatgggaagaagtggctcaggaaaaacaactttgcttaatattttatcaacaattgatgatcttacaaaagggaaattatttatttatggcaaaaatatatttgaaatgtcagatagtgaaaaagcccattttagaaaagaaaacattggttttatttttcaaaactttaatctattagatacacttactattagagaaaacattcaattacctctcaaactcgcaaagaaaaaagtagatcaagatgattttgatcgtattgttagtgaattagaaatcacagatattttagataaatatccttttgaatgttcaggaggacaaactcaaagagtagcggttgctagaacattagttatgcatccaaagattatttttgctgatgaaccaacaggaaatcttgatggcgttcgttctaaacaattaatgcaatacttagaaaagattaataaagaagataatataacagttattatggtaacgcatgatcctttagatgctgcctattcatcgcaaatgtactatattgaagatggaaaaataaaagatcatttgataaaaaatgatgattcatttgatacttatttttctaaaattgttaaaatatctatggaattataaaagaaagaagtttcttttatgttgttgttaaggtcatatcttatgttgtttgtgcctcttagctatttattttaaaatataagatttaaagtattggtgaggaggaaaagaagatgaaaaaacaagagaaattaatgattggaattattttaatagtttgtataggttttattttttataattttcaaggaagggacccttataaaaaatataaccatatacaatcaagtgaaattatgaaagtaagtagacaaagatattgggtttatttttattcgatggataatcaagaaagtatagattctagtaatgggataacacgtcttatgaaggcaacaggaaatgtatattttgtgaatattaaagataagaaaagtgaatttcaacctacaacattactttatataaaaaatcatcaaatcattaaagaatataaaggtttgaaggaattaaaaaataaacgccaagaaatattagaaatgaattggtgaacaatctattctttttagtataatagataaaaaggtggatgaatatgaaagaaataaaattaacggatattaaaggtgtaaaagtaggacaatatgaaaatcaagaagcagctacaggatgtagtgttgttattgtagaaaatggagcgacagctggagtagatgttcgtggtggaggtcctggtacaagagaaacagatttattgaatccaatcaatatggtgcaacaaattcatgctgttatgttaagtggtgggagtgcttttggtttagatgcagctagtggtgccatgcaatatcttgaagaacatggtgttggttttgatatgtctgtagcaagagtaccaattgtatgtggtgcttcattatttgatttatcggtgggaaattctcatgtaaggccagataaagaaatggggtataaggcttgtcaagatagtgaaaatgatttgattaaagaaggaaattatggcgctggttgtggtgctagtgttggtaaacttttaggatttgaacatgccatgaaaggtggtattggaacatatggtgtacaagttggaaatgttcaagtagcagggatcgttgctgtcaatgcttgtggaaatgtcattgattataaaacgcaagaaatattggcaggtgtaaatattgataaaaaatgtgtttcggctagtcaaattattttagatcaaatggatcaacttagaaaattaccagatggaaatacaacaattgcttgtcttgttacaaatgtaaaacttacgaaagcacaatgtacaaagattgctggaattagtcataatggctacgctaaaagtattgatccagttcatacaatgagtgatggggatacaatttttgtattaagtacaaatgaagttgatggaatggttgatgctgttggtattttagctgttgaagtcatttctaaatgtattcaaagagcgattaaaaaagctaagagtggatatggtttattagcttatcaagatttgaaaaaataatcgaaaaagcatataattttcttgttcgtatattttgatattaaaagagatctataagactcttattaagacatttgaaatagcgaataccataaaaacgttgcatcttttatgagcgacagtaggaggattatatgaagtcgaaaaagacacagtacatgacttcaatggctttatttttagcgattgaaatcattcttgttgtgacaccccttggatatattccaattggaccattaaatgccacaacaatgcacattcctgtcattattgcaggaatcgtattaggaaaaaaagcaggagctgagttgggttttgtttttggattaacaagtttaatcaaggcaacgattcaaccaggcattacatctttttgtttttccccatttgtgacaataggcacaatgtcaggaaattacaaaagtcttttgattgcttttgttcctagaattttacttggctatttagctggactcgtttttggaatcatgaaaaagaataatcgtgaaaacttaggtgttgttgtaggtgctttaacaggagctattacaaacacagtgcttgttttatcaggaatatacatattctttggtgaagcatacgcgagtgcggtaggagtgcaatactctactttagtaacggtattattaggagttgtttctacaaatggtattttagaagctattctgggagctattgtttcactagctatctacaaagcattaaaaccaattttaaaatcaaagcaggtcgattgacctgctttttaaaggagatctttatgaaatacatatttgttagacatggaaagacacattttaatgaaatacagctcaaacaaggatggtgtgattcacctcttacaaagcaaggaataaaagaaatagaaaatatggcagaacagttaaaggattataaaatagacgctgcttatacttctccaatattacgagcaaaaaatacagcacaaataattttaaaaaatcattctgttttattaaatgaagatggtcgtttaaaagaagtgaattttggtcttttagaaggattaccttgtttatttgtagataaacttcaattagaatcttctaattggttagatgatttacaaatggattatactggatatgaaggtgaaaatgttgaagatgtaattcaaagacattttgaattattaaatgatatagaaaagaaatttcaagatgatgatacgattttaatgataggtcatggatgttctttatatgcatttattaaaacattattaaaaaatcaaaaacttgattttccacaaaatgccagtgcaattatagttaataaagttaataatgaatatcaattagaaacagtattaaatccaaaataaaaaatcttgaaataatcaataattttattgacatgagtggcatatgatggtaatatctacgtgcaataaaaagtagtggaaagaagaagtgcctacttctcgcctgattgattttgtcgataggcaaatgtcactaagatttaatcttaatgtcaatggtgggtactcagtgtgctcactttttatttcaactataataattggaggtggcttttattagcagatttgataacagaaaaccaaaacaacctgatgatttagtaaacgaaagagttcgttttaaggaagtattggttattgatcaaaacggtgatcaattaggagtaaaaagtagtagagaagcgttggatattgcttatgatgcaaatttagatttagtttgtgttgcacctaatgcaaaaccaccagtttgtcgtattatggactttggtaaatatcgttttgaacaacaaaagaaagcaagagaaatgaagaaaaactctaaagtggtaactttaaaggaaactcaattatcagtaactattgatacgcatgataaaaatgttaaattaaaaagaacattaaaatggttagaagaaggaaacaaagttaaagttgcaatcagatttagaggtagacaacttgcacacgttgatttgggtaaaaaagttattgatgactttgttgaagaatgtgcagaagttggtcaaattgaaaaaccagcaaaattagaaggacgtactttaacagctatattagcaccaaaaaagaaaaaataattaatggaggaaacaattatgccaaaaattaaaacacatagcggattaaaaaaacgtttaaaaagaacaggtagtggaaaattaaaacgtagccatgcttacatttcacacttatcacacaataaaactcataaacaaaagaaacacttagcaaaagctacagtagtaagtgcttcagattacaagagaattaaatcaagattacctaaataattttagttaaaaataaatacaggaggaatacacaatggcaagagttaaaggtggatatacaactagacatagaagaaaaaaagttattaaattagccaaaggatattttggagctaaacataaattatataaaactgctcatgaacaagtaatgcactcaatggcatatgcttatagagacagaagaaacttaaaaagaaatatgagaaaattatggattgcacgtattaacgctgcagctagaatgaatgatatctcatattctaaattaatgcacggtttaaaattagctaatgttgaaatcaacagaaaaatgttatctgaaattgctatctgcgatccagaaggtttcacagctatcgttgaaacagctaaaaaagctttaaacgcttaataaatcatggaccaactgagttggtcctttttttattatcatattcgttgacattctttttaaataagtatattcttaaatcatagcaaaactataggaataaggaaaaatagaaaaatgagcgaaataaaaaatagttttttagacctagtagggaatacaccactagtaagagtaaacaacttaatcaggcttaaacactaggttttactagaggtttgagctttttttatatcttgttttaggtgctttgcttggttaaactagggcatattaggttgaactaaaagtgtgcaaaaaaatgaaatataatcttataacaaaatatttaatgaaaaaaatgtaattctaagtgaaagttctacatttttttatcatatatttaataaaatgtatgctataattacaaaagagagggtgattttatgttttatagtcaaacatgtgaaaatataaaattgattatttttacgttagatggtggcttattagatctcaatagactaagatataattattatcgaagtacatgtgaaacctatcataaagttgctactcgtgaagatttttctaaaatgcttggaaatatgaatacgatgtatgatcattctttactgtctgattatatttctgctaaagattttaatagaatggttgaaaaggatttatttgaatatattaaattaaaacctaatattaaaagagaaggcgttgatgagttgattcaatattgtaaacaaaaagatatcaagattgcagtatatacgactcataaaacaaaaagggctattcaatatttacaacttgcaaagatctatgaaaaaattgattttttaattggtggagattcacgacttaaacctttacctgaagtggatattttagaggtgacgtgtcaacgaatgaacattgatccttctcatacaatggtggttgctaattttgaatcaatggttgaagcggctaatcaattacttgcaaatgttatttacatgccagatttagtgccagccagtgataagataaaggccagtgtttataaaataactaaaaatcatttagaaattatgaatatgtttttattttctaagtatgattctgtggaattgttttcaccgcttcttggaatgaatgcacaaatggatttggaaactttgacacatactcgaaatcaattattggataaatataaagatgatgagcaattaattgcattggttaatagaacatatgattatttcaatgaaatcttatcaaaacaatttttaattaatgagttagaaaaacaagaaacaaagagattttcatttgatgatgaacaaaatgataacgttcaagaggttcatgataaatttaatgatgttgttttagaacaagagcaagaagatgaaattttacctgatgaacaggatgatacgtttctattttctaaggcatcttctttggatccccaaagaatgagtgaattaatggatattataaatggagatgccgtagatgaaaaaagtcatgaagagaataaaacaaatgaagaaaataaaaataatacgatagaacaagaacattggttaaataaagtaattgatgttgtttataatttattgatttcggttattattgtattttttgctttaattgtacaaattttatttcaaggaaattcttctaaactttcacaaattatcaatatgataatcgatggttatgtaggaattataaattttatttttggtgtgttgtttgatattttacatagttttataagtgtaataccatcatataaaatgtttgtttatcataattcatcgctatcatcaatggcagtaattgcgttattggctattatttcaaattttattttaataactttaattaagaaaattgttcaaatgttgaaaaaagactaaaaaatagtcttttttttaaaaaactatttacaaatgtaaaattagatgatattataaatgggcactgatgtgatggagacatactcaagaggctgaagaggcgcccctgctaagggtgtaggtcgggaaactggcgcgagggttcaaatccctctgtctccgccattttatttggtctggtagttcagttggttagaatgccgccctgtcacggcggaggtcgcgaacctacgaccgatcggttaacagccgattgctctaccaactgagctattcaagcaacttaacagtgctcatttatattagcatcctttttctaataaatcaacccttttttatatttttttaaaaaaaatttaattttatgtcaaaaaccgtttcttcttgtaatattatataccattctatatttgattaatggtataattatataaacatataatataaggaggatcctatggaccaacaaagagaacaagcaagtcaaatcgcacatgaatttattgtttatcaagaaagtgaacaagcagatattgatgcaaaagatcatcaattcgatgctttatggcaaagtatatatgatgtatgtaaacttattaaatttggaataatagaagatattactgaagaagaatttgaggaagcctacgcttggttaaaaaccactcaatctcttacagaagattatcaagaattagaattagaattttaaggagatcaaaaatggaaaaatatttaattgtgacagacacaacaagtgcaatggatcaagaaattgcacaaaaaaacggaatcgaacttatttcattaagtgtcatcgttgatggtcatgaatataaagatcaaatcgatatttcaaccaaacaactttatgactatttaagagatggtaaaattccttcaacaagtcagccaaatacaggttatcttgttgaacaaatggaaaaatggcaagaagaagactatgaagcaatcattattattacttgctctgcagatttatcaggaacaaacaacggtttccatcttgctaaagataccgttggtttagataatgtttatatttatgatagtcgccaagtaggtgctcctattatggatatggctatttgtgcaaaacaacttgcagatgaaggaaaaactgttgatgaaatttttgctgctttagaagaaaaaacaaatcattccttttcgttcctttatccagataactttaaacaactttcacgtagtggaagattatcaccaatggcagccagaatggcatcgatgttaaaaatcaaagctttgctttgtttagatgaacaaggtaaagcagttgataaatatacaatggctagaactgaagtaaaaatcttaaaatcgattgttgataaattccatgaattaggtgttaacgctaaacaacacaagatttatatttcacacgctgataatgaaatttttgctaaaaaagcaaaattattatttcaaacaaccttccatggtattgatgtagaaatcaattatttgcctgctgttttaacatgccatggtggtcttgcctgttgtgcaattcatactacatataaaatttaaggagtgattaatgatgaaagttgttgatatgcattgtgacactattttaaaactttatgatgatttacatcatggtaaagaaggttctttattagaaaatgacggtcatattgatttaaagaaaatgcaaaaaggaaattatttacttcaaaactttgcgatgtttgtcgatttaagtgaaaatcctcaaccttttttaaaagcaaatcaactcattaaccattattatcatgaaatagaaaaatatcctgaactcattaagcctgtcttttgttatcaagatattatcgaccatcaacaagcaggtatcatgtcttctcttctaacattagaagaaggtgctgttgtagaaaatgatttatcactacttgaacattattatagattaggcgttagaatgattactttgacttggaatcacgtaaatggcattggacaccctaacctttctaatatttcttgttatgaagatatgtttaaaatcaatgatcacgatggtttaacaccttttggtttacaatatattaaagaaatggaacgtttaggaatcattattgacgtttctcatttaagtgatgctggattttatgatgtttatcatcatacaacaaaacctttcgttgcctctcatagtaacgctcgtcaagtatgtggtgtcgctagaaatatgtcagatgacatgattttaaaacttgctagtcgtggaggcgttatgggaatcaacttctgtagtgattttttaactaccgaaggtactcatcaaacaagttatattaaggatatggttcaacatattttatatatcaaaaatcttgcaggtattgattgtattggtttaggaagtgactttgatggtattggatccaagcttgaaatgaaggatgcaagtggttatcaaatgttatatggtgctttaattgaagctggattatctattgaagaaattgaaaagattttttataaaaatgtcttacgtgtttataaagcagttttgaaataggattggaaacaatcctatttttaaaaaaacaaaaaaatgcgtatctctatctcatcattttagaaaaataatgttataatagctaaatgggagggactacttatgtatattaaagatgatgaaattaataagtattttaatgagcccaattggaaagtagctcataacttatttcaacataatacaatatctaacatgtctgttattaaagatggtcaaatttaccaaatcgtaggaagtactaatgttaatggtaaaattgataccgctacaattcaagttgatacaggaggacatatcctcgaatttaactgtgattgtaatcactgtaagcctaatgaactggcatgtggacatataggtgctattttattaaaattttacggtcttgaagcaagtgatttaccttattctttcaatcaaaaaggaaattacgctgatcaattacaagcacttcaagcaaaaaaagaagccgcacatttaaaagaacaagctaatttaactttttcattaattgaacaatataaaaatcaacatcgtttacatcaattacaacttaatcaacacattcatttaataccacaagtaaaaagtacatttaatcgattaagtttatcttataagattgctagcgatagaagttatacaattaaaaacttaaatacttttattcaaaatgtaaaagcaaacgaaattgttgaatatggaaatgctttagttactgatcataactctaaagcctttgatagttcttcattaaaacaaattcgttttattaaagaatattttcatttaaaagatgatgatcgtagtattagaatcacatcagataatattgatgatttttttctaacacattatgataatttagatatcaacattaactttacaacaatcgatttacaaaacttcattttagaaatccaaaaagatgaagattatacaaccatcaaatacaaagaacctgatggtattactatcatcggtcatcaatatatctattatttcgatcactatacccttaatagatattcaaaagaatgtagtgatgcgctaaggcctttacttacacatttagaaaataattcacttacaattccaaataacgaattaccacatttttctaaatatatcattgattctgttattccttatgtcgaatttacaggagatgatatcgatgaatatctacctatggatatttctttattaatttatgtcgatttaaataacaacaacgaattatctgttacattagattatcgagatgatcaaggaaatacaatcttagaaaaccctaaagatctagtacttccattaaaattagatggtgttattcaaacactacaaaaatacctagaatatgatgaaatcacacaaatgtattatctttataacgaagaagatatttatgatttcattactcgtgttttaccttcacttaataatgattgtgaaatttatattagtgaagaaatcaaacaaatgaataaacctaaaaatatgaaattaaatatcggtgttcgtttacaaaatgatttattaaaaatcgatatcaatagtatcaacgttgataaagaagaaattaaagatattttatatgcttttcaacacaaaaagaattatcatcgtttaaaaaatggggaatttattaatttagatgatgatagtatcaaagatttagatttattatttaatgatttaaatattgaatataacgatttaaaagatggtgaagttgaagttgataaatatcattcactttatttagaaaactttatgaacagttcatcattacatttcaacagagatcaacatttccaagacttgatttctcatattgaagaaaaagatcctgaagatattcaagttccacaaaattattctaagattttaagagactatcaagttcaaggatttaaatggttaaaaacaatgtcagaatatggcttcggtggtatcttagctgatgatatggggcttggtaaaacattacaagtcatgacattgattgaagatggtatcggtgaaaatcatgtcagtctcgttgttgctcctgcaaccttgatttataactggcaagatgaaatcaaaaaattctcaaagaaattaaaaacagtttgtattactggaaatattgctcaaagaaagaaattaattgaaagcatttcagaatatgatgttgttattacttcatatgattatattcgtagagattatgaattatataaagattatcaattctattattttattttagatgaagctcaatatatcaaaaatcaaagtacaaagaatgctcaaactgttaaattaattaatggtaaatatcgttttgctttaacaggtactccaattgaaaatagtttagcagaattatggtcaatctttgatttcttgatgcctcaatatttatataattatcatcatttcaaagaaacttacgaaataccaatcataaaaaatgaagaccaacaaaaacaagcaaaacttaagcaattagttgaaccatttattttaaggagaacaaagaaagaggttttaacagaattaccagacaagattgaaaacaatgtcattattccttttacaccagaggaagaaaaagtatatcttgctaacttatcaacaattaatagtgaattacaaagtgctattcaggtaaatcatatcgataagatccaaatccttgcaatgatgacaaggcttcgtcaattatgttgtgatcaacgtattttatataaagatatcattgagccaagttctaaacttaaagcttgtatggatattattgaaacagcaaaagaaaataatcaaaaagtcttactattctcttcttttactaaatcattagatttaatcgaagctgaattacgtaaaaaagatatttcttattatgttttaactggttcaacaacaaaaatcaaaaggcatcaacttgttaatgcattccaaaacgatcaaacaactgtctttttaatcagtttaaaagcaggtggtactggtcttaacttaacaagtgcttctaccgttattcactatgatccatggtggaatatgtctgcacaaaatcaagcaacagatagagcttatcgtattggacaaacaaataatgttcaagtttataaattgattatgaaaaattcaattgaagaaaagattcaaaaacttcaagaacaaaaacaagatttatcgaatatgtttatcgaaaacaataatggttctattacccaaatgtctactgcagatattattgatttatttaaataaagaaaaaggagatcaaagacgttcaatctttaaatctccttttcttatgtaattcaattttctaaaagctttgtaaaaactaaatgttaaaattgctggagcaatcacatctatcaaaataagtggtatccaatactgatttcccattacttgaatcgcatccaataagcctacaagtcctgctgttcccattcctgagccaattgcactgcaacaaatatgaagtaagaccgttgaaataggtgctgtaataattgttgttaaaattgtaggtaaccaaataaccggtcttctaataatatttttaaactgtaacatacttgttccaattccaatagcaataacatcaccaatatcattgtcttcaatagacatcatcgcaaaaccaatcatttgtgcgcaacaccctgcaagtgctgcccctgccgctaaaccatcaagtcctaacataataccaatagcagctgaagaaatcggtgccgttaatgccattcccattaacacccctacaacaattgacataaataaaggttgtaaagaaaccccatcattaataacacttccaatccaagtaatcatttgtgtaagataaggtcctacaaattgtgttaccaaacctgctatacagatagaaacaaaaggaacaagtaaaatatcaatcggtgttttcccttgaataagtcttgttacctcaatagccactaaaactgctacataagctgaaattggattacccgcttgaacaccattattaaacgttccagctcctattgctcctgcaataaccgcagaaatcaaattaagtccttttgcatcaattgcatagcccataccaattccaatggccggtcccattaaataacctgctactgtcccccaggttacaagttgttcaacatgaactaatgttcctaattgttttaatattgttccaataatcaaacttgcaaaaaagccataagccattccattaaaagtattgattacataatttccttttcctctactttgtgccatattttaccccctcaattggattatagagtatatttatttttttacaacaaaaaaactgccgaagcagttagtttatttattggtggagccaagcgggatcgaaccgctgaccccctgcgtgcaaggcaggtgctcgtgtgttttcatatataacaccccttccttaacttcatctaacactatagagtggctttatagtcaagggtttttatcaaattttgaatgaattgtaagaaatcctggttgatatttattttcttgaacataaatccaatgattttttaaatagccattaataacttctaaaatcttatctgtaggataacttttcccttcttgtctaagttctaaaccacaacatgtacatccaccaacaccatgaatcgaatattctatattattttgtttaagtaattgattgatttcgagaatcattttaaaattaacaacattattcatagtcatctctcctttactttattataaacaaaaaggaagaacgaatcttcctttataaacacattttataaatattcaaacaatctttttgacttaatgatcgataagctctaggtaatgcatcttgaccatagcaagcttttactttcaactcatcaaatttttcatcattaattcctacttcacttaatgatgtaggtaaatgaagttcatctttaataaagttttgtaaagcttcaattcctgcttttgcattagccatgtcatcaccttgatcttgaatacccatcacatttaaaccaaaacgagcaaaatcttcaacaacagtttcatctttgtttaataaataagtcatccatttaggggtaatgatagcaagagctaaaccatgagtcatatcataagttgatgagaattgttcaagcgcatgaagttgagcttgtgttttgtatcctgatgtacaaaaactatttaaagcccatgaagcagcccataacattgttgctctagctgaatagttttctggttcttcaacagcaattggtaattgttggcgaactgttcttaataatgtttgaacaacattgaattgtaatgggtatttatcgctattaacaaaatagttcatatcaaataagtgagccataatatcaaatcccccacatgctgtttgtttagctgaaacactaaatgtatttgttggatcaaggaaagctgctttaggtcttaagatatctccattgattccacatttaacacctttttctacattagcaatcacacatgatttatccatttcacttcctgttgaagcaattgtaggcattgctagtacgggtaaggcattattccacgctactttcttttctactaaatcccaaatattatctgtatcagcaagtgttaaagccgcaatggctttagaggcatcgattgttgaaccaccaccaataccaagaatggatgtaacatgattatctttacaaatttttgctcctttattaactgttgtatgtcttggatttggttcaacgcctgcaagttcataaacttcaatattattctttttaagttcttttataactttgtcataaagtcctatttttttaattgaacctcctccataaacaacaagtacacttttaccatattttaatacttcttcatgtaaatgacctaattggtctttaccaaaataaacttttgttgtgttttgaaattgaaaatcgttcattttattttcctccttctggttttaaaggcccatagtaataagaagatgttgcgccaccatccattaagaaagtagatccagtaataaatgctcctttatcactcattaataattcagctacatttgcaacttcatccgcagttcctggtctacctgctggacatttagcaaacatatttttataaaaatctccccttggtccattaaattcatcaatagcaagcggtgttacaataatacctggggcaatagcgttgattcttgcaccacgttgtccccatttaacagattcagccattacacgtttttcattacatctttttgctaattgataagcatgtaatgtatctttaatattttctggttgtaagatttctaagtctaataattcttcagttggtgtacaagcaagttgttcatcttctaaagctgtaagttgtttcatacggaaacctgattgactagaaattgtcacaccaacgccaccttcttcaataacttttcctacttcttctaataaaacagctgttccataaagatcaacttttaaaatagcttcgattggtgcttgagaaggtgaaaccccagcgccattgacaagcattttaatgggtccataatttttagccatatcaatcatttttaaaatatcttgtctacttgataaatccatttctataacttcaacatcaaatcctgcatccaccattgtcttttgaatatttttagcgttttcaatatttttatcacctagaataattttcttaccagcacccattcttctagcaatcgccatactgatttgaccagcaccaacaacaatcataacttctttcattattctttacctgccttttctatacaatcaatggcatttaaacttcttggatatcctacaaaaggaacattttgtgaaacgactttaattaaaaatgcttcatcatttcctaatcttatattcgctttggcatgggcaatggcttgtggcttgcatccaccttgtgcatataagaaacagaaagtaatcatttctctttgtttataatcaagtccacctcttgtatagtaatctccaaaacagttatctgttaaccatttacgaatatacattgttttaggatcaccacttgtcgcatatcctctcatttcttcaccaaagattgctacttgtgcttgctctcctttttctaaacgattggtattaggatcattttgattttctaatggaagttttaaacctaaagtctcttcaataaaactattcacagcttttaagaaaggaaaaactctcccaattcctaaataagcaacagcttgataaacaatttctttcatttctactggagttactccaaaattatatgctgctttcaacattcctttaaattcgtcaattccttggcatcctaataaaactgcaagaattgaaataaatctagttttatcatctaaatcatcttgatttacaacttcatcaaatgcgaagttatcaaaagcttcaataaattcaggatctgttcttaaaaaatctgaaacataccctggaaacattttttcatgataatttttagcgttatctgtcattttatttttctcctaatcctctttctaattgttgtctacatccatcaacatgacttccatgaatacttaagcctttatgaaggatactatttggacaaagtttctttaaatcactttcacttcttcccataccacttccttcatggctacaaatcggatagatatgcttattggtaaagtcataactttctaaaaatgtcataacaatcgttggcattgttgaccaccagtttggataacctaaataaattgtatcgtattcatcaatactttctaatggatctaatatttgtggacgggcattatttttaagttcatcacttgcacgctttgtacattcatgataatcaaatggataagcatccacttctttgatttgataaatatctgcatcaatcattgtagataatgtttcagcaatgacttgtacattccctttttctaaattaacaatatttcccgagaaataattttctttattatgcgaaaaataaacaattaaacttttactcattgatttttatctcctttgctatgttatatactttttctattgaatctgttttttcaatatcatctttattccctgtttggaaacctaaaatagaatctacaaaacgattaccaccaactcttaaacaatcaatatatttttggaaagtatctttgatgattctaaaataactttcttcaggagctaatcctgttgtaagtagatagaaatctttgtcatgaattgttttttcaatcacaaatgtacgatcaattaataacttcattgaagcattaaatgtataaaaataaaccggtgaagcaaagacaatgacttttgcttctaacatcttttcataaatttcttgcatgtcatctttttgtacacattgatttgtcttttgacaaatattacatcctaaacaaggtttaatattttgataattgacataaatcttttctgtgctatatccattttcttctacacctttaataaaagcattcgctaatcgatctgtattcccatgctttcttggactactcattaaaacaagaacttgtgccataattactcactcctttttccacttatatgataaaaaaaagaaggaattgaaacaatttcaattcctaatcatctttataagttttacttatttaatatttctttatacatctttacaaattcttctatataataattggttttatctttagaccaacaagcaaaataatttctttgaataggcttgcctttataagataattcaattctttcaattcctgacataggcttatctaaatgaccgatttgatcaattggtaaataacctctttggctagctaccattaaacgtgcttgttccaaagaatccgcataaagaaaacgatgtgaaagatttagtgacttttcataaaattctctttctgaatcttctctctctttagaaacaacgataatacaagacatattctttaaatcatcagcactaataacttcttttttagataaaggagaaagtgttgagatttcaataaaagaaacactttcttttaagttttcattataataatctttattaaacgttcttctttgttcacttattttcatatcaatacgatgatcaactaataattcaaacaattcctcatgtgtaccactgactactgaaatattaacttctggataaattcttttaaattcaacaattgtttctaataattcattagtactaaagtttttaggataaccaattgttaggtttaattcctgatcttctcctcgacgaattgtttcttctttaaaatcttcaatttcatcaagaagtacttttccatgacgataaaaatattctcctgccgctgttaaagaaaattgtcttttacttctttcaaataaacgtacccctaattccttttctagagctttgatttgttgggaaatagctgattgtgaaataaaacattgttcagctgcttctgtaaaactatgtaaatcaacaactgtgataaaatatttcatttgtttaagtaacatggatttcacctctttttatattttactgtatttttaagttctctgcacaaaaatttgttataatttagaaaaggagtggaaatatgaaaaaaataatcacagtattactatcttgtataatgcttataagcttaacaggatgtgccatgtttgaatcaaagatcaacgatattaaaggaaaccttgttggtaatggttataccattgatacttttgataactatggaaaaagagttatgacaacaacaggagataaaataaatattcaaggtaatcctgtagaaacaacttcttatgatagtgatggaagtattattacaggatatgaattatcttcagttattaccattaccattgatggtcaagaaattgaatcttgtggagatacatgtatctttactcaaaaaggattagaaccaaatgttgattttactcaagaagacatagaaagtaatgataatggaaaactttcaaataatacatatatcgctaatattattaataagtataaaaactactttggtaaatcaagagttgttgttattaagtctcaattaggtcaaccaattacagcttattcaggagatgaagtttattggtcagttcctaaaaagttacctaaaatgacaaagcttatgattgatggtaaagctctttatattcatcgtgcaaattatcaaatcattgatacagctttgttaaactaaaagacggcattgccgtcttttacattgtaaataaacttaagatatcttctttagacatttgtgataatccaccactattattttctacaaacatatccgctaattcttttttacgtttttgcatttcaataatcttttcttctacactatctttcatcacaagattaaatacttgaacattactcttttgaccaatacgataagcacgatctgttgcttggttttgcgccgatacattccaccatgggtcataatgaataacattttcagccgatgttaagttaagacctgtaccattgtgcgaaaatagctcgttgccagttccttcttttttttatgtttttacatgctgttaatcataagttcaaatttgaatgctattattttattgtttttttgtagctagctaatagggtaaaattcttgattatatagtttcaaaaataaaaatatgttataatagattgggtgatgttttatatgaaaattaaattatattttggaatggaaaatgctattaagaagtctggaataggtcgtgcgttttaccaccaaaagaaagctttaacattaaataatattgaatttacgactgataaaaacgatttggattatgatattttacacattaatacaatctatcctgatagtatttcaatgattaaacaggcaagagaaaataataagaagattatttatcatgcacatagtacagaagaagattttaaaaattcttttatgttttctaattcctttgctggtctttataaaaaatggcttgtgtatctttataattcagctgatgttattattacaccaacaccatattctaaaagcttattagagtcatatgatttaaataaggaaatatatccgatttctaatggtgtagatgttgcacagtttaatccaacatctaaacaaattaatgagtttacgcaacagtttcatatttctgaagaggataaacttgttatatctgtaggatggctttttgaaagaaaaggatttgatacttttgtagaagttgcaagaaaaatgcctcgtgtaaaatttatgtggtttggagatgttagattatccaacccaacatctaagataaaaaaattactcaaagaattaccagaaaatttaatattaccaggatatgttagtggagatattattaaaggtgcttatggtagagcagatgtttttttctttccatcacgtgaagaaacagaaggaattgttgttttagaagctttagcttgcaaaacacaaatattattaagggatattcctgcttttgatccatggatgcaagatcgagttaattgttataaggggaaaacaaatcaagactttattgattatattaataaaattattaatcacgaattaccttcgacaatagaagaaggttataaagttgctaaagaaagagatttattgctaataggaaaacaattaaaagaggtatatgaaaaagttgaatctctttagaggataatattatggataaaaaaaatataaaaaaatacatactaaatgtagctattattctaatagttggtggattatcaatttatttttcaattggtaatcaattagaaggaacgattaaatcgttaaaacattgtcatttagggtggctattggttgttgccattttaatgtgtattttttatttaatcaatgcaatgaatttgacactttttgctaaagtatataaaaaagattataccttaaaacaaggaatcgtaaatgcaatggccggtattttctttaatggaatcacgccaatggcctctggtggacaattttatcaagtatatgcttttaataaacaaggaatcaaagcaacttattcgtctagtattttattaatgatttttattgtctatcaaagtgtattggttgtgtatacatctatcattatgcttttaaaatttgtttattttagtaaattgtattctggctttttttcactagcatttgttggatttattattaatttagtggttatttctactttgtttttaggagctaagtctgaaaaacttcaaaattttttaagtaataatgttgttaaagtattagcaaaattacatatagtgaaaagctatgaagaggtaagttctcaaattgaaagaaaattagaaaactttagaatcgaacttaatttattacaaaaaaacaaaccaatattacttaaatcaataggattaaatgtattaaaattgacaattctttatagtattccatttttttgttctcttgcaatgaatgttcctctttcttggagacatttctttgatttaattggaattactgcttttgtttatttgatttcagattttgtaccattaccaggagcaagtgggggtagtgaaggttcgttttatattttacttcgttactttttaaaaggagctacatcagcaactttacttgtttggagatttgctacttattatgctggtcttattcttggaggtcttacaatgtcatttagtagagaacttaattttgcaacaaaaaatgataaaaaagaaattacagaaaataatcaaacaattgttatagaagatatagaagaaattgaatttgatgattttaaaaaataggaggtctttatgaaaatagcacttttttcagatacatacatacctgatattaatggtgttgctacatcaacgaatattttacgaaataaacttgtaaatttaggacatgatgttttagttgtaacaagtgaacttccaagtgatacaacttatgatgaaagcctagatgatcaagttttaagagtgccaggattagaaatacaagctctttatggctacagggcatgtaatattttttcttttaagggtatgaaagaaattaaaagatttaatccagaggtcattcatgttcaaacagaatttggtattggtatttttggaagaattgctgcagaatatttagatattcctgttgtttatacgtatcatactatgtggacagattattcacattatattaatccaatcaattctgaaacagtagatactgtcgtcaaaaaagtaattacaaaaattagtaaattttatggaaatagttgtcaaggattaattgttccttcaaataaaacaaaagatgctttaatccattatggtttaaaacaaaaaaatatttatacgattcctacgggattagaacttgaacgtttttcagttaataataaaaacaacgaattatgtcaaagtttaatagaaaaatatcatttacaaaatcattttgttcttacatttttgggaagaattgctcctgaaaaaagcattacggttatcatagatgctttaaaaaaagttgtcgctattaatgataatattcgttttttaattgttgggggtggaccacaattagaagagttaaaagaatatgtaaaaaatgatcatattgaatcatatgttatttttacagggcctcaaagtggtgaaatggttccagcacattaccatatttctaatatgtttatttcagcatctttatctgaaacacagggattgacttatattgaagcaatggcgtcttctattcctgttattgctcgttatgatgatcaacttgaagatgttattgatgatggaaaaaatggctttttctttaaaaatgaagatgaattaccaaaacttatattagatgctatggaaatggatttagatgttttaaaagaaaatgcattaaaaaaagcaaatgagtatagtggagaaacatttgctaagaaagtattagaagtttataagcaagccattcttattaaagaatatacttatacaattgtttcgatatttcccataaagaataataaaaatgaggtttcatttacttatgatgaaaatgaaagtgctgtaacattagaattatcagataaagtaatagatcaatataaactgtatcgagggaaaacaattgatagaaaccagtttaatacacttaaagatcacgaacaaatcagtagggcatataacaaagccttgaagtatttatctattaaagattataccgaacaacaaatgagaaagaaattaatggattctggagattatgatgatgctcaacttgatactactattcaacttttatcagaaaaaaatttaattaatgataaaatgtacgcaatgaattattttaaaagatgtacacgtttgggaataggacataacaaagcaatttataatttaagaaattatggtgttgatactgagataatagatacatgtttagaagaacttgatgatgatgaagaatatcaagcagcgatgcttttaatcaataattattaccaaaggaacaacacgatttcttatcgtaacattcaaagaaaaattaaagaaaaattatttttaaagggatttacaaatgatgttattgataaagcaatggcagagtatgattttgaatatgatttagagaaagaaaaattagctttggaaaaagactatttaaaagcatctcatcgctatgaaaaaaaattagaaggaaaagatttaagaaacaaaataattgatacattgttaaaaaaaggatataattacgaagatattaagaatattctagaagttaaggagaataatgatgaataaaatagcaagtttaaaacctggtgatgatggtgttttaattgaagcattaattaatcatgttgtatcaggaaaaaccaatggagcacatcgctcaacgtatttatctatgacattacaagatgatacaggatctattgatgctaagttatggaatgctagtgaagaacaagtacaaactctagtaaaaggttcagttgttcaaataaaaggtgatgttataaaatataatgaagatagacagatgaagattgtaaagattcatttagcgtcacaagatgataaagaacgtattaaatttttaaaacaagcaccattggatagtcaatttatgatcaatgaaattaaaaagtttattgatcaaatagataatttaaaattacatcaattagtaaaaacattatttgaagaaaatattgaaaaattatcttattatccagcagctagcaaaaatcatcatgaatatgtttcaggattggcttatcatacgtatggaatgttaaaagttgcagaatcattttgcactttatatccaacgcttaataaagatctattatattctggaatcacattacatgatttaggaaaaacaattgaattaagtggtcctgttgttccagaatatacgttagaaggaaaactattaggtcatatttctatttcaaatgcaatgattaaagaaactgctgataaactttatattgaaggagaagaagtaactttattacaacatatgattttagcacatcatggaaaaaatgaatatggttcacctgttcttccgcaaatcaaagaagcagagattttatatttaattgataatatagatgctcgtatggcgatgatggataaagctttagaaaccgttgaatatggaaaatttacaaaacgtgtattctcattagaaaatagagcgttatataaaccaaagatgtatgaaaagtagcaaatgctactttttacattttttcaaaatatgaaaaaagaaatttgtatttttatagaaaaaaaattaaaaaagaatataattatgtcagtaatttattattaaaaagtgaggtagtataatatgtataagattttattatgttgtgtatcaggggttacaacaaacaaattagtaaatgcagtgaaagaatctgctaaacaaaaagatattaaagtaatgtgttgggcagttggatctaaatctgtaggtttatcatgggcagatgctgattgtgttttattagcgccacaatctgcttcagaattatctaaaattgaagaaatggttcacggggttattccatgcgctttaattaatgatggtgattttgcaagtatgaacggagatgctgttttaaatcaagcattagatttaattaaaaaataaacatcctaagcgatgtttttttttgctataataaaatttaggaggaatcgaaatggctgaaattatgatcaaggcagcaggttttgtttttgtaattataatagcgtttattttaaaacaagtgcatgttttagaaaaaagagatggtttaacaattgcaacaattattatgaatgtgacattaccttgtgctttacttacaaatgcaagtggcataacaattgatcaatcaatgatcattttattattaataggattagcatcaaatattatcatgcttttcatttcttttatgctttcaagaaaagaggaaaacattttaaaaggatattatatgatcaattgttctggatataatataggaaactttgttatgccgtttgtacaaagctttttcccaggcatgggagttgcttatttatgcatgtttgatgtaggaaattcaattatgtgtttaggaggaagttatgcgttagcaggaagcgtagcaagcagtaatcaaaaattgactcctaaaacagtaatcaaaaaattattttcatcaattccatttgatgtatatcttttaatttttgttttagcactttttaaaattttaatacctcaaccaattttatcaatggcttcttttataggagcaggaaatggatttttagcgatgtttatgattggacttttattagaagttaaaataaatccttcggaaatgaaaatagttttaaaaacacttttgattcgtgtgctttttggtgctatcttaatgagtattgtttattttattgttccaattccaatgcttgctaaaaaaattgttgttttagcaatggctgcgcctattacaactgtttcagctgttttttcaaaaaatattggttatcatcgtgatgcatcagctatttcgagctcactttcaattattatcagtattgctgttttagtcgttttaattatcatgtttgcgtaggtgagtgtatggagtatgatttaaaagttttaaaaataaataaaaataaaatagaacagttaaatgaattatctatttatactgtaaaagatttagtacaacattatccttatcgctttgaagaaatgttagaaacaccattgcatgatgaatcgaaggtcattattgaagcacagcttattgatgaacctaaaattttttataaaggaagattttcaagattgacttttcatgttaattatcatgaagaaccattaacaattacgatttttaatcgtcattttttgaaaaagaatatgcaagtaggaatgatgcttactattattggtaaatacagtgcttctaaaaaagcaattacagctagtgacttaaaactaaagaacttaaaagaaatttctggaataacaccagtatattctttaaaagaaggactcactcaaaaaagttttcagggttatgtcaataaagcacttaatttttataaaggacatattgctaatactattcctttatatttatgtcaaaaatatcatttgatagataaagaagatgctttgtttaaaatacatcaaccgcaaacacgcagtgatgttattagtgcacttagatacttaaaatatgaagaattttttaaatttcaaatgacaatgcaatatataaaacaaaatcgcacacaaaatataggtatctcaaaattaatagacaaagaaaaagtgactcactttattgaaaagctcccttttcaattaacagatgaccaaaaaaaagtcgttgatgatatattaatagatttaacaagtcaaaaattaatgtatcgctttgttcaaggtgatgttggtagtggaaagacagttgttgcagcaattagtttatatgctaattatttagcaggttatcaaggagctatgatggcaccaacagaaatactagcgcttcagcattatcagtctttaaaaaaaatgtttaaaaaatataaaataaatatcgcattacttacaggtcatctttcacaaaaagaaaaaaatgatatctatcagcaattagaaaatggacaaattgatattattattggaacacatgctttatttcaagaaaaagtacaatataatcaattaggtctggttattactgatgaacagcatcgctttggtgttgaacaaagaaaagcgttaaaagacaaaggaaataaagttgactttttagtaatgacagcaacaccgattcctagaacacttgctatttctttatatggagatatggatgtttcaacgattaaaacacttcctaacgggagaaaaaaagttattacaaagtttattaaaggaacatcgatgaagcctatattaaaagatttgaaagattatcttttaaagggaggacaatgctatgttgtctgccctcttgtaaatgaaagtgaagcaatcactggaagaaatgcaagtgatatttcaaaagcaatggcacaatatttcaaaggacaatacgaagttggattagttcatggacaaatgagtgatgaagaaaaaaataaaatcatgaatgcatttaaagaaaataaaatacagattcttgtttcaacaacagtaatcgaagtgggagttgatgtaagtaatgcaaatatgatggttatttataatgcagaaagattcggtttatctcaacttcatcaattgagaggaagagtaggaagatcaaaggaacaaggatattgttatcttttatcagaggcaacacattctgaacaaaaggaaagattagaatttttagaaaatcatcatgatggatttgaggtctctgaatatgatttaaaaataagaggacctggagatttgttgggtcaaaagcaaagtggtttaccaacttttatgataggagatatttttaaagattatcatattttagaaattacaagaaaagatgcttttgaagcgatgaatcaacatcaagatgatgaaaaaattataaaattgttatcagaaataaaaaacaatttaataaagaataatgaatatattgattaatgtgttataatgctaaaagaggtgagaacatgaaattagcgatagacgccatgagtggtgatttaggtagctctattgttgtagaagcctgccaatcatttttaaataaaaataaaacagatgagctttatgttgtaggaaaaattgaagaattagaagcattgaaagatcatcctcaagtaactttaatagatgctagagaaatctttgaaatgacagaaaatattttagcaatccgtagaaaaaaagaatcgagcttagtaaaagctatgatgttagcaagaaataacgaagttgatgctgtattatcttgtggaaatacaggagcctattatgcatgtgcaatgttgtttttaaaacgtattaaaggaattgaaaaatcatgtttaatggcaacaattcccactttaaatgataaaggtgtttgcatgttagatgtaggggcaaatgctgaaaatacagtagatcaactcgttcagtttgcaattatgggaaatgtttatgctaaaaatgttagacatattcaaaaacctaaagttgccctgttaaatattggaagtgaagaacataaaggtgatgagatccataaagaaacatatcaatctttgagtacacttgaacaaattgattttgttggaaacattgaaggaaaagaaatcttaagaggtgatgtggatgtcattgtaacggatggatttacaggaaatgtcacattaaaaacaattgaaggtgttgcattatctatgatgtctgcattaaaagatggttttatggcatcaacacgtaataaattaggggcagttatttctaaaccagttttaaaaggattaaaaacaaaatttgatcctgcaggtgtaggtggtgccctgatgatgggatttgtaaaaccagttgttaaagcacatggtgcaagtgacgcgaaagcttttgaaagtgcaatgaatttagcttttgaaatggttgaagtaaatgtagtagaaaaaatgaaagtaggtctagatgaaagtggaattaggtaagtttttagaagtaatgggcattccttataaagatattcatttatttaaagaagcttttacacatccttcttatacaaatgaaaacaaaggaaaaaattacgaacgattagaatttttaggtgattcagttttacaatattatgtatcaaagtttatttatgaaaaatatcctgaaaagccagaaggagaattgacacttttacgttctaaactagtaagagaagaatcacttgctcgtttttctcgtgaattaggattaggtgcgcaaattttcttaggtgcaggtgaagaacataatggtggtagagatcgtaatagtgttttagctgatatttttgaagcctttattggggcaataagcgaagattgtggtatcgaatatgttttaaaaatattagatatgacaatctataaacatgttgaagatgtcaactatgatgatatcacagattttaaaacaaaattacaagaattgattcaagcggatcaaagaaagacagtcacatattcattactttcaacaacaggtccagcgaatgcacctgaatttgaagtggcagtcatgatggatgatatgaccctaggaactggaaaaggttctagtaaaaaaagagcagaacaaaaggctgcaaaggatgcgttgaaaaaattagccagatagatagcaaatgctatctatttttttgcctaaacattttttattttaaaacatattttaaaatgaaggaggcaaaatatgtttgatgaagaatatgaaagagtcattcatccccgtagagtaggtgatatctatctctatacagtaagaccgggagataatgtttatcggatagcaagaaattttaatactaaaatagaatggatcgcttgtatgaataaacttgatcaacaaatgatgatttacccagatcaacaattatatattcctttcattcctcaaggaccaatgccaatggtacaatcaagagattcttatgaattatatttttaatggactagatttttcttaaaaaaaagcttattatattcgtaaaaataacaatgaaggagaattttatgaatagacatgcaggaagtgaaagaaatctaactcttgtaatggatttatatgagttgacaatggcatataattattttaaacaaggaaataaagatcaacttgtttattttgatatgttttatagaaaaaacccagataatggagggttcgcggtttttgcaggattacaacaattaattgaatgtataaagaatttacattttagtgaaggagatattgaatatctccgttcacttcaaaaatttgatgaagattttttagattatttatcagattttaaatttacaggttctatttatgcaatgaaagaaggtacaccagtctttcctaatgaaccattgattactgtaaaagctaaatttatcgaagcacaaattatcgaaacgatgttattagtaacagttaatcatcaatctttaattgctactaaagcacatcgtgttgttcaagaagccaaaggaagacctgttatggaatttggagcaagacgtgctcaaggatatgatagtgcaacttatggagctcgtgcagcttatattggaggggtagcaggaacagctacagtttcagcaggtgagatgtttgatattcctgtagtaggaacaatggcacattcttttgtgcaatcatttgatagtgaatatgaagcttttaaagcttatgcacttacatatccagatgattgtgttttattggttgatacgtatgatactttaaaaagtggagtacctcatgccattgaaatagccaaagaagttttagaaccaatgggtaaaaaattaaaaggaattcgtttggatagtggagatatttcatatttatcaaaacgtgcaagagcaatgcttgatgttgcgggtcttacatatgtaagtatttcggcttcaaactccttagatgaatatttgattcgctctttattaaatcaaggagcgcaacttgattcatttggagttggagaaaatttaattgtatcaaaatcatctccagtatttggaggagtttataaattagtagctattgaaaaaaatggacaaattattcctaaaattaaaatttcagaaaatactgaaaagattaccaatccaggttataaacgtgtatatcgtttgtttgaaaatgaaactggaaaagcaatggcggatttaattgctttttatgatgaagaaattgattgtacaaaagatttaacgatttatcatcaatctgatatttggaaatttaaaacaattgaagctaatacgtatacagtagaagaattacaagttcctatatttgaagatggaaaatttgtttatcaagaattgtctgtaaaagaaattagagattattcaatgaaagaaaaagcacgcttatgggatgaaatatttagattagagttcccacataactattatgtagatcttactaagagtttattagattttaaaattaaaatgttagaagaaaagagaaaataaaagtggcaagatttgatagaaaagtagaaagaacaaagaaaagttttgaatttacacaaaaagagaaaattgttgaaacaaacaaagatgtctttaaaaagaattttacatttaaatgggtccaattaaatattaaaacagtatgtgtttttcttgttgattttttacttgtaacattattgattattccatttatgatgcaatatttaaatgcaactttagcgtttgttttagggcatggaattattacaagtttagtgattgtttttacaggatttttaattaataaagaaaaaataaaagcagttccatttatttctagattcttatttatgtttattctattaggtgcatcttctgcactttcgatggcaattacatcatggctgaattagtttgtttaactgctttaggggttgtttcattatttacaggaattgtatcattaggaaacagtgatgcttttatgggaatgtttacctttatgatcttacttgtaagttatgcattgattatccttacttttagaaaaagaagaatgctttttaaagcaaaagaagttatttatacaggatatgaaatttatttgtatatattatcatatgttgttttaatgacttcttgtttattgatatatcttcatgttgttcaagttgtttcaatgacatcaccattaattatgatgacatggcttgtaccacttgttgcttatttaacgtatgaatcggtattgatttttgaaaaagatgaattaaatataaatgggaagaaagtattatatagaagtatcaaaaaagttcaaattatagaaaataaaaataagtatcatttaataattagagcgaaaggaaatgaatatctatacaagacaaatcaaaaaaatagtcaacatgttttagaatgtttaaaaaaatattgtccgcgtatagataaaaatagggattaaatatgattataacagttgttggtcttggtgttgttgggggaagctttgtaaaagctttaaaaggtcaaggacacgaagtttatggtgttgatgtagatgaagaaacacttgcaagagcgaaagcagatggatgtataaaagaagggtttgtagatggtcgagaaattatcaaaaaatcggatatgacgattatctgtttatatccatcattagttttagattatataaaaaaacatgaatttaaaaaggggagtatcattacggatgctgtaggtgttaaaactcattttttaaatgaagcaatggatcttttgaaaggtaaagatgttgaatttgtttcagggcatcctatggcaggaagagaaaataaaggctatctttatgcaagtaaagaagtttttcaaggcgctaattatattttaattcaacatgaagaaaatagtaaaagtgccattgctatgatggaacaatttgtttctaatttaggatttcattccgtaaaaatcatgtcaccacaggctcatgatgagattatttcatttacctctcaattgccacatgtcattgctgtttcattgattgatagtgataatcaaaaatatgatacaggtaaatatattggagattcttatcgtgatttaacacgtattgctaatattaatgaggatttatggactgaattattctttactaataaaaataatcttttgaaaagtatccaaggttttgaagatcaattggatattttgaaaaaagctattaaagaagaagatgcagatactttgaaagcaatgtttattgaatcttctaaaagaagaaaaaatcttgagaaatagcgttaggctatttctttttttgtatcgtgtttaaaatattaaactttttgtttaaaaaggtattgaacttaacataattattagtataatagtcttgtttaataaataaaacaaaaagtttttttaaataaacaggaggttttatggatattggtgcaaaaattaaaagaatacgtttatcaaatcaattgacgttagaagaacttgctaatcgtagtgaattgacaaagggttttttatcacagttagaaagagatttaacgtcaccaagtgttgccacattagaaaatattttagaagcattagggacaaatttaaaagattttttttcagaagatgaagatgaacaaattgtttttagtaaagatgatttttttgaaaatatacaagatgattataaaatttcttatattattccaaatgctcaaaaaaatgaaatggaacctattttaattgaacttaaaaaaggaaagaagtcaatggaaattgatccacatgatggtgaagaatttggatatgttattcatggaaaaattacattaatgaatggtgatgaagaatatgaggtaaaaaagggagaaacattttatttaaaaggaaatttaccacattacatagtcaataaacatgatactctagcgaaagtgatttgggtatcaacaccaccaatattttaaaaggggagaaaaacgatggaagaaaaggtactcattaaatttagaaacattgttaaagaatttgatggaacaattgttttaaaaggaattaacttagatatttatgaaaatgaatttgttacactgcttggaccaagtggctgtggaaaaacaacgttacttcgtattttaggtggctttttagaagcagatgaaggggttgttatctttgatgatgaagatataaaggaattaccaccctataaaagagaattaaatacagtctttcaaaagtatgcgttatttccacatatgaatgtttacgataacattgcttttggcttaaaaataaaaaagatgtcaaaagatgttattgatcaaaaagtcatgagaatgttaaaacttattggtttagaaggttttgaaaataaaaatgtaacaacattgtcaggtgggcaacaacaacgtattgccattgctagagctttagtaaatgaaccaaaagttttattattagatgaaccattaggtgctttagatttaaaacttagaaaagaaatgcaatatgaattaaaaagaattcaacaagaagtaggaattacttttatttatgtaacacacgatcaagaagaagcgttaacaatgtcagataagattgttattatgaaaggtggagaaattcaacaagtagggactcctcaagaaatatacaatgaacctgttaataaatatgttgcaaatttcattggtgaaagtaatgttatttcaggtgtaatgattgaagattataaagttaaatttgatgatcaaatctttgattgtgttgattttggttttaaaccaaatgaaaaagttgatgttgttttaagaccagaagatattgatatagtgcctttagaacaaggaaaaattacaggagaagttttaagtgttttatttaaaggtgtttggaatgaagcaatggtagaaactgttcctgggacaactgttaaagttaatatgaatgtcattaaaaatcatgatgtagaaagtgaatatagtgatgagagaatttcagcaaatgatttttatgtagatattgaagaagttgcttctttagatgataatgatttgattgctagagcagatgcacaagcatggaaagaaagtgatgattcttatatttcaattagtaaaattgaacataatttaaaagaagaattaggtgagtacactgttactttccaaacatcatcaggattatctgtttctagaaaaattattgttgttgatcaaaaatatgtaaaaaatgaaaaagcaaatgaagcagtaagtgcctttaacttctttaaaacagttgatgaaattaaagaatcagtggctttagatacagatttaaaaacatgggctaatgctattggatggaaattatcaaatgaagatgaagcagtggatatttatgtagattatgattttgatcctgaaaacataaaagaaggaatttatcaagtaacattttcaacagaaggtagagaactaaaagtacatacaacagattatgtagaagaaggtcaagaggtcggattgacttttgaagtagaagatattcatgttatggaaaagatgggattctagatgaaaaaattttctcaactagctttaccttatattatttggagtattattattctacttttgccagtattacttattgctttttatgcagtaactgatagtggaaatactgttgttaattttagttttactttacaaaattttgctaagttttttaccgatcatgatttcttacttattttatggagatctctttcaattgcatttaaaacaacaattatttgtattttgttaggatatccaattgcttattttatttctcaatgtaaagatcgtacaagaaatattcttgtattattaattacacttccaatgtggatcaatatgcttgtaagaacatacgcttggattggtattttatctgatggaggtattttacaatctttattaaatttattaggatttaaatcaacacaacttctttatacagaaggagctgtattattagggatggtttataactttattccatttatgattttacaaattaatacatcactttctaaaatggataaatctttattagaagcaagctctgatttaggagcaaaccgttttcaaactttttggaaagttacatttccactttctattccaggagtcattagtggtatcgcacttgtctttttacctgcggtaagttcattctttattcctaaattattaggtgggggacaatatttcttaataggtaatgtaatagaaaatcaatttattactgtaggagaatggaattttggttctgctatttcagtcattatggcatttgtaatgatggctattatgtatttagtaagatatgttgaaaaacgtaattcaggtaatagaaaggagaaaaaagcatgaaaaaagaaaagcgttcatttttaaagatattaatgggattaatgcttttatttttctatttaccaattggctttatgattgtgttttcatttaattctagtaaatcattaacgcattttacaggattttcaatgcaatggtatacaaaaatgttatctgatgcatcaatgatggaatcattgtatataacgattttagtagctgttattgcaacagttatatcaactgtggtaggaacgattagtgcgataggtttatcaaaatctaaaaaagtcgttcatgatttgattatgcaaatcaacgattttcctttgatgaatccagaaatcgttacagcgattggcttaatgttattctttattacctttaatattgaaaaaggttttgcaacattattattggcacatatcgcattttgcattccttatgttatattatctgttatgcctaaaattcgctctctagatccaaatttagcggatgctgcaatggatttagggtgtacaccttggatggctttaattaaagttatcgtaccacaaatcatgcctggtattgtttcaggggctttgattgcttttacaatgtcttttgatgattttattatttcttattttgttacaggaaaaggaattaaaaacttgagtattatggtttatacaatgtcaaaacgtgtaaatcctagtattaatgctatttcaactttaattgtaatttttattacgattgttttaattcttgtcaatgttgttccggtgattagagaaaaaagaaaagttcaaacgacagaacttaaagaaaaaaataaagcaccaagaattattgctggaattgttgcagcatgtgtatgtatgggactagtttttgttcaaaaaacaacttcttcgactaaaaaatatgcaggacaaactttacatgtctataatgccggggagtatacgggtgaaaatttgctttctaattttgaaaaacaaacgggatgcaaagtagttatggatttattcgattcgaatgaacaaatgtatattaaagtagctaatggtgaagcttatgatgttttaattccaagtgattatatgattgaaagattaaaacaagaaaagcttattcaaccattagatcaagataaaatcacttgcttagaagatattaatgattctgttaaaaatttatcttatgatccgaataatgaatattctgttccttatttttggggaagtgtaggaatcgtttatgataaaacaaaagtaagtgaaaaagatttaaaagaacaaggttttaatattttcttgaatcaaaaatataaaggagacatttatttatacgattcggaacgagattcatttatgatggctttaaaagcacttggctattctatgaatactgataatgaaaaagagcttgcagaagcttataattggcttttagagtgtgttaatacgatgtcaccagaaattgtaacggatgaaattattgataatatggctcaagctagaaaagctttaggattaatatattcaggggatgcgacatatgtcatgtcagaaaatgaaaatattggttattacatgccaaataaagggacaaatatatggtgtgatgctatggttattccacaaagttcaaaacatgtagatttagcacatgaattcattaattatgtttcaagttatgaagcagcttatggtaattcatcttatgtagggtatacttcaccaaacacggaagttatgaacgatttagcgcaaaatgactttaaaggaattaatgcttataatccaattagaacaaataaatatgatgaagtctttaactataatgctgaaacaagaaagataatggctaattattgggctaaagtaaaaatcgcagcctctaatgctaaaagtgaataataaaagttctatgagagttttctcatagaattttttttaaaaaataaaatcaaaaaaacgatgaatatacgtatagaattttaaatccataaaaaatagattgtaaaaaattataaaaaactattgcaaaaaaattttttatagcatataataatggggcagcgtgataagagacgcgaagcaaaataaagaagtggttccttggccaagttggtaaggcaacagactgcaactctgtcatcatcggttctgctctaggaagggtaatggcatacccctaacttgcactgcgacctatcagaaacgaactggtcagccaacaatgttggcaggtagcaggaatcccctgcctttagacatggggagtgtcaaacaagtaagtattataatttataaaaaaggagggattatgtatgtttgatgttcatcttacgacaattaaagtgattgatattgaaaacaataaagtggtgattgatagtacttttggagaaaaagaatatgttttagataagattaaaaatggagttagatttgaacttcctaaatacaaaagtgccttacaatatcaagaaaaaaacgatgtatgctatgtattcacaaacaaccaaggtaaaaagctatttactgctttagattcaaaattaacccaagaattattaaaaataatatcataattttaagtaataaaaaaggagccacacttggctccattattattatgctttacattcagcgtttcctaattcattaccttcattgaagttacgtgcattttccattgtaacaacagcgattgcttgtaaagcttcacgagtaaagaatgcttggtgacttgttaaaacaagttgagggaacatttgtaaacgagctgtgatatcgtttgtgatagcaacatcacttttatctgtataaacgttattatcttcaccttcatatacgtctaaagcaacagcatggaatttaccttgttttaatgctctaattaatgcttcaggatcaatgataggtcctctacttgtattaactaacataactgtatctttcattaaagcgattgtttcatcgttaattaaatgataagttccattatctcccataattaatggacagtgtaaagaaattaaatcagctctctttaataattcttctttacttacataagttaataaaccttcatcaactaatgcttggttaggataagcatcccatcctaaaactgtcataccataacctttacaaattctagccatacattgaccgattttaccagtacccatgataccagcaactttattatgtaggtctaaacctaataaaccacttaaagcaaagttattatctttaacttttgtataagctttgtgtaaacgacggtttgcttcttgtagaattgccattgcatgttcagcaactgcatatggtgaataagcaggaacacgtaaaactgtaattccatattcttttgcagcttgtaaatcaacattgttgaatccagcacaacgtaataagattaatttaacaccacattcatgtaatttttcaacaactggtcttgaagcgttatcgttaacgaagatacatacagcatcataaccttgagctaaaccagcagtttcaggtcctaattgagaatcaaaatatttgatatctgaattgtaagttccttgacctttatcttttactaattcactaaagaaagttctatcataatctttagttccaaagaatgcaatttttaaaacatctacaggtttcttttcttcaaaagcaccatgtaataattcttcgattgcttttgctgcaacttcttcgtcatcaccatcgatatccactcttaaagtatcaccttttttagcacctaatgctaagatttgaagaacgttgtctccatcagccactttatcacctaagtgaattcttacttggcttttgaaattcacgcaacattgagcaagcaatgcagcaggtcttgcatgaatacctaatgtgttattaactacataactaatttctttcattttaaatctcctccattttgcaagaccattttagcacaaaaaaaatgagaataaagaagaaattgagaaaaattacaaaagtgatggaaattttataaaatatcactataataggtttgtcaagagggggaaaaataatgctaattattaattttatcttaggtttattacctattatctggttagtaatcgctttatgtggtttaaaatggccaggatataaggctgctttaggtgccttaattattgctgcggttgaagcattaacatattttggattctcaatgtcagatacattaacttctgttttagaaggttttgcgtttgcaatgtggccaattgttatcgttattattgcagcagtttttacgtataacttatctttacgtacaggatcaatcgatatgattaaaaaattacttacaagtgtatccgctgataaacgtgttttagttttattaattggatggtcatttggtggtttcatggaagcaatggctggatttggtacagcagttgcgattccagcaagtatgttatgggttttagattttgatccaattctagcctgtcttgtttgtttagttgccaattcaacaccaacaccatttgggtcaattgctattcctacagtaacacttgcaacaaacttaggtttagaaaataacttaattgcttttgcaacttcttgtgctttaagtgttttaattattttaacaccatttgtgatggtttatattttaggaaaaagtacaaaaggaaaaggttctgcctttaaaggaattgtaccagttgttttagtttcaggattatctttcttaattccagaaatggttgtttcatattttgttggtgctgaacttgcgggggttgcagcttcagttatctcattagtatgtacaattttagctagtatgaaatttacaaatccagacgctattcctgatgaatatcgtttagaagtaaaaaaaggaagtcctttaaaagtaggaaaaactttacaagcgttatcaccgtttattttaatctttgttgttttattacttacaagtaatttagtaccaccaatccatgatgcgttatcatcatttgcgacaagtgtaaaaatttcaacatacaaaaacgcaagtatgacaacatttacatggatcaatacaccaggtgtcttaattattttatgtgccatcgttggtggatttatccaaaaagcaaaagtatcagaaatggttgctgtctttattgcaacattaaaacaaatgatgtttacaattttaacaatgttatttattttagcaacagctcgtgttatgcaatattcaggaatgattgctgccgttgccgctttattttcagtatttggacctgtttatccattctttgccccaatgttaggagcattaggtacattcgttacaggatcaggtacaagttcaagtgctttatttggatcagttcaaatgtctactgctgcaagtattggtgctaataaatattggcttgctgccgcaaacagcttaggtgttgctactggtaaaatgatggcaccacaaagtattgctattggattagtcgctgttgatgaagcgggtagagatggagaattacttaaaaaagtattaccatacgctgctttattcattattattagtgcactcgtatgtttctttggacaatacgtatgggcaatctttggaattgcttaaattaaaaataaatgatttaggaagtatctgtaaaaagatacttctttttctttaggtagattttaaattattatatgaaaagagaaatcacagtaaatgatttcttttttaattcattataaaaagtaaatatgtattaatttcatagaaaatcctcgatagaaaggagattttatgagataataggtgccaagaaggtggaaaaatatgaaaaagggaattatgagtagttttattattttaggggttttattatcaggatgtgggagtcaaaaagaagaactttattcttcatcaaatcctgttgatattacagtatggacctattataacggagatcaattaagttcgtttaatacgttagttaagaaatttaatcgtacacaagggaaagaaaatgggatatatattgaaagtgtttcttgtggaacggtaaatgatttggaaaaaaatcttaaagattctattgaaaagaaagtaggagcaagtgagattccagatatgttttcagcctataatgacattgcttatacaattgatcaaatgcatggtattgttgatttaaataaatattttagtgatgatgaacttgatgaatatattgagggatatgttcaagatgggaatattttaaataatggaaaattgaaagtttttcctgttgcaaaatcaacagaaattttaacaatcaataaaacagattttgatatttttgcaaaagcaaccaatgtaagttctaaagatttatcaacaattgaaggacttgtagaagtttcacaaaaatattatgaatggacggatagtttaacaccaaaaccaaatgatggaaaagcgttctttggtcgtgatgcgatggcaaactatattttggcgggttctatgcaattaggagatgaaatctttaaagttaaaaatggaaaaatgaaacttgattataatgaaaaagttgcacgtaaattatgggataattattatattccttatattaaaggttattttactgcttctggtgtctttagaacagatgacattaaaacaggaaatattattggttatgttggatcgagttcttcagcaacttattttcctaaaaccgtaacaaatagtaatgatgaaacatattcaattaaaatggaaaccttaccatgtcctcaatttaaagatagtaaaaattatgcgattcaacaaggtgcaggaatggctgtaatgaaaacaacaaaaacaaaacaacaagctgctgttgaatttttaaaatggttaacagatactaaacaaaacgtacaattttctaaagaaacaggatatcttcctgttaaaaaagaagctaataaagtagaaccacttgttgataataacaacaatatggatactcaaaaagttgtagaagtttcaattgacacagtaaaagaaaatgcaatgtattctccaaaagcttttaaacaaggaacaacagcaagagcctacttacaatcaatgatggcagataaagcgactgaagatcgtcaagttgttgaaaccaatttaaaaaatgggcaagatcttgatcaagcaacagcttcatttaatagtgatgaatactttgaacaatggtatcaagaaacaaaaacgcaattacaaacatatgaagattaataggagattatcgttatgaataagatgggaaattctaaaacggtatatcggacgattttaaggccacttttaatagtggttcttgttgaaattgtcttaatgacaggaagttattggattttggggattaatgatcagcttgataaaaatgctagagatattttgatacaacaaacagaaaatagaagaagctatctacaaaatgaaatgattcaaaagtggtctaatttatcaacgatttcacaaacaattaatgaacgtactcaacaacttattgaccaagatgtcatttctttacaaacattggattcttcaagtaaagcaagtgcgccacttttaaatgagatttctaaggaattgatttcaacgctttatagtaaagaagcaacaggaatttttgttattttaaatacacatgatttaagagaaaataaagataataaaccaggaatctatattcgaaacaatgaccctaatacgttttttgtaaaagaatatggtgatttgcttatggaaaaagcacccgtggaagttgttcgttctcttaatatttcaacggatacgcattgggaatcgacctttgatctttcaacagaagaaaacactttactctataaaccttttgaaaaagcatatcatgataaaataaagatggaagtaaaggaatatggctattggaatgaaaaaagctatcatttaaaaaatgatgataattctgcaatttcttattcgatgccacttattttaccagatggaaccgtttatggagtggtgggtgttgaacttcttacttcttatttagaaaatttaatgccgatcgatgaacttaaaaatgataatcaaggaagctatgtcctttctgtagaaacgaatgatcaacacaattctttagttgtttcctcggcaccagtaaagcgtaaacaattaaaaaaattctatttaacagaagataatgataaaaataattttgtctttttaaatgggaaagaatattatgcagcagttcaaaatttgaatatttataatagtaatggtcctttctctaaacaccaatggcaattggtatcacttgttgaacgaaatcaactttatacattctctaatcatattttttacctacaaatttcaatgattgtattagtaggaattgtttcattaattggaatcttttatgtgtctagaaaaatatctggacccatcagtcgcctttctaaagaagtagataattcaagactagtaaaagaaataccagaattacacgcaacaggtattcaagaaattgatcagttttcatccgcaattactgctttaagtcaagaagttttggaaacgtcgacaaaattcttaaatattatgaatatggcaagtattgatattggtggttttgaaattaaaaaggaaagtaaaaatgtctatgtcacagacaatttcttcttgttgcttggtattgataaggtcactcttcctttaagttatgaacaatttgaagaattatttaaagaagtagaaagagattatcaagttgaaattgaaaatgaaaacgaacgtatttactgtataaaaaaatatgtaggcctacgttatgtacgtttgaaaatgagaaaagaagcagatcgtgaaattggtattgccgaagatattacgacaaattatttagaaagacaacgtattgaacatgaacgtgattttgatgttttaacaggattatataatcgtttttctttccaaagacacatggattatctatttgaacactctgaacaactaaaaattgctgccttggtgatgattgatttagacaacttgaaaaaaatcaatgatgcttttggacatgattggggtgataactatattcaccaatgtggaaaatgtttccaagaaaatgttcctgaaaaaacaatttgtgcgcgcgtttcaggagatgagttctatttattcttatatggttatgacagtcaagaagaaatacgacaaagacttatttcaatgacatcaattatgcaacatagaacagttttattacctaatggtaataaaatgaatttaagtgcctctattggaatctcttggtatcctcaaaatagtgtttattttgactttttgaaaaaatatgcagattttgcaatgtatcaagttaagaaatctacaaaaggaaatcttgcagaatttgataaggctctttatgaagatgaaaaacttaatcgacaaatgcgtttagaattccatcaattaattgaaaaggaacaattagcatatcatttccaaccgatcctttctgcaaaaaatggagaaattatcgcttatgaagctttaatgcgtagtcaacttgctactttgaaaaatcctgaaatgattttaaaaattgcacgtgaggaaaataaactggaagatgtagaaagaatttgtatttttaaatcaacagaaacttttgatcaattaagaaaaaataaattagttaaagaagatgctttattatttattaattctattgcatcggtgtctttaaatgatgaagaccgtacacgcttccatcactgttttagtcatattcaatcacaaatcgtcgtagaagtaacagaagaagaaaatatgtcagaagaagctttggttcgtaaaagagaaaccgaaggtttttcaggaatgtttgcgttggatgattatggtagtggttataatacagaaattaatttattaaatttaaatccaaaatacataaaaattgatcttactattgtaagagatattgataaagattttgataagcaacaacttgtttcaaatattgttgagtatgcacatcaaagagaggcttatattattgcagagggtattgaaacgaaagaagaacttcttaaagtcttagagttaggggtggattatttacaaggttattacttatcttatcctcaatcaaaccctcaagaagtttttgatgaatctatacaaacaattaaaaattattggaagaaaagatgatgaaaaatcatcttttctttgttataattgttagcgtttgataacaggaggctagaaatgagcagacatacaagaaaatgtcaatgtaaaaaagtacattgttagagtatcatgaaattattggatgtatcatggcggcattagatgctaaaagtccttatacggcaggacattcaaaaagcgtaagtgatatggtagaaattctttgtagattacttggtttaaatcggatgatgcatattgctgcccatttgcatgatattgttaaaataggaattgatgatgcgattttaaataaagaaggaaaattagatgaacaagaatgggaaatgatgaaaacacaccctcaaataggtgcgaatattcttgataaatcacatttgttagcaccttttagtaaaattgttttacatcatcatgaacgatatggcctcaacgggaaagaaattcctttaggattacgtattattgctttatgcgattcaattgatacgatgacataaaaaattatcgagatatatagacaattgatttttgttatcatgaaatagaaataatctagggaaaagtagttttctcttttttttcgtttttatcaagaaaatgacaaaaaaacatacaatgtcatgaggtggttttacatgttaaaaaaaggattatgtttattaatagggatcatgatgcttttttgtcaaatcaatgttgttcatgcaacaaatcttgcaagtggggcagaaagtgcaattttgattgatgcaaatagtcaacaagttttatatcataaaaatgaaacgaaaagattatatcctgcatctacgacaaaaattatgacaatgattttattatttgaagctattaaagaaaaaaggattaattggaatgatacacttagttgttcagcctatgctgcaagtatgggaggaagtcaagtttatttagaagaaaatgaaaaaatgagtgttaatgaactttttaaatgtgtggcaattgcttctgcaaatgatgcatctgttttaattggagaaggaattgctggcagtcatcaagagttcgttaaaatgatgaatgaaaaggctaaacaattgaaactggtgaatacacattttaaaaattgcacaggacttcatgacgttgaacattacacatgtgctaaagatttagcaaccatgggagcgtatttaattaaaataggtgggaaaaaactgttttcagtaacatcgttatatgatagttacattcgtgaaaaaaatcatcaaaaattttggcttgttaatacaaataaacttttaaaacaatatcaaggggtcgatggcttaaaaacaggttataccaaagaagcagggtattgtattgtaacaacgtgtaaaaaagataatttacgtttaataggtgttttaatgaatgaagataagccccaaacacggaatgaagatatgaaaggtttattgaattatggttattctaagtatcaacaaataaaactctattctaaaggagaagtgttagatacgttaaagatcaaagatttggttgatcaagaagttaaagttattacacctaaagatatttattatttaaatgatagagcaagtaagggagaagtgaaaacgaaaatcaaatataatcaaatagaacttcctgtttttaaaaatcaggaaataggagaattagtagtgaaaaaacaaaataagacaattgcaagttattctttatatttagaaaaagatgtcaaaaaaatgaattttttagataaattattgagagtctataaatcgttgatttagactctttttttgtcattatttctagttttgtcgaatctattttttttctttttaagatgagctaagatgcatttaaggagatgaaaaaatggaaaataaaatggaacatgaaattgaaaatggacaactgattatttcattttacggagaaatagatggttataatgttgcgtattatcgaaataaattaaatgtacttctagcgattaatgatgatgatgtcatttttgattttaaacatacgacttttatcgatagtgcaggggtagggttggttttaggcaggtatcaacaattatctaaagaaggaagaaaattatcacttagaagattgtctaatacagcttataaggtttttgagttaagtggattatttgaaattatggaatatttaaaggaggcgcaaatatgacaaatgaaatgtcattatcttttagtgcaactttagaaaatgaaccttttgtaagaacatgtattgcctcttttgtggtttgtttaaatcctacggtagatgaaattgtagaaattaaaacggttgtaggagaggctgtttctaatgccatcattcatggttataacggtgataaaggctgtcttgtaaaggttaaagcttatatcgaagatgatttgcttacaatctatgtcattgataaaggacaaggtattcaagatattgaaaaagcaagacaaccgatgtttacttctaaaaaagaattagaacatgctggaatgggactgagtattattgaagcattatgtgatgaaatgacaatcgaatcttctttagaattaggaactcaactcataatgaaaaaaagaattgtccatgaataaagaagctgttttaaacaatattcaattagcacaacaaggggatgaaacagctaaggaattaattgtaaaaaataatttaggtttagtttggtcgattgttcatcgttttaagaataattattatgataaagaagatctttttcaaatagggtgtattggtctcatgaaagctattaataattttgatgttcattatggtgttcaattttcaacgtatgcggtgcctattattatgggagaaatcaaacgctattttagggatgatgggacaatcaaagtttctcgttcacttaaggaattgaatatcaaaattaacaaagcaaaagaaaaattaattacactttatggttatgaaccgacggttcaagaaatagcaaaggaactggaagtagatgtcatggatgttgtagaagctatagatgcttcttattatccaacttcactttctgaaccgatatatgaaaaagatggatctacaatttcaatggaggaaagaatagaagataaacatcatacaatgtggtttgaaaaaattgcattgaaattagaaatagaaaaacttgatgaaaaagaaagacttattttatatatgagatatcagttggatttcaatcaagaaaaagtggcgcaaagattaaatatttctcaagtacaagtatctagattagaaaagaaaatcattacaaaattaagaaaacatttgaatgaatctcattaagtgatataattcattcaggtgattttatgaatgaaagaaaagaaagtacgacatcaattatattggaatatgtaagagttattgttttaacagttattgcaacttttatatttttacagtttgtgcaaatatcaagagttaatggttcaagtatggaaaatacttattttcaaaataatattgttttgattgataaagttttttataaacatagtcaacctaaaagaaatgatattattattgtagattatgatgatggtttagatgatacgcttattattaaacgagttattgctgttggtggggatcatctagatattaaaaataatgaagtgtatattaatggtaaaaagctaaaagaaaattacattaaagagaatatgaatacagaagatctttctattgatattcctaaaggaaaagtgtttgtcatgggggataatcgtaatcattctttagattctagaaaattaggctattttgattttgataatgatgtcattggtaaagtcttttttaagattcctttataggagtcttttttttgtatagatatgtaataaaaaaacatccgtatgataaacaaatcttaattgtataactttaagcaaaaaaatcgaaaaataaatcatatttttactgtttttattttgcttgtgaaaaaaattatggtaagataatgtcaatcaataaggcaatttatggggaatcttattggtggaaaggatgataaaatgtcatataaatttaaaattactagaggaaatgcaattcttaacttttcagaagaatactgtcaatcacgttgtgagttgattgaaagcgaatcttttgcgcgtgtacttaaagggtatgtacacgatatcaaaagaaagaaaacaacagcttatgaatacttgagagaagttcaaaaagaaagtattgatattgttgatgatttaagaacggtttttagattattactcgttatggatcctaaggaattagcttcaatttatcctaaatttgctccatattttagagatatggatgaatttacacaagtaattgaagatatctatttattctggcgtcgtttacaacgttatagtgtggtttataacgaagaatcaagagggggatatcaaaacgttcaattcgctgatgcacaagctaactttgaagcgcttgttttatcagtatatcgatcaattaaaaataaatgtattggacaaagtgaaaatgttttacgtcaaatcactgcaggtgtcaatgcagggttacgtgtttcaaatatgcgttcatttttaccatatgaatatcgttgtttagacaatattccatttattgaatcagttattattcatccaccttttattacatattcaaaacgtaataaaagagatggggttttccctgaaacaaagaaaaacccaattgaagatttaaaatttgatcaagatcaatggttctgttatcctgcaaaagtaggagatctattatgttttgtttatttcaatgtcgcttatatggcacaaggtgttactttatgtaacttattccaattagcaactgaagaagaatatcgtaatagaaaaccagatatgatttatgtttatggatatgaagatggtaaaaaacatcaatatttctatcaagatgatgaaaatgatatgatggttgctttactttcagcaaacgatgaatttgattatttcggttacatgaagaaaatgatgcttacattacacaatgtaagaaaaatcaataaaaaacaacttccagtccatggggcaatggttcaaatcactttacaaagtggagaaacaaaaaatatcgttgttatgggtgatagtggagctggtaagtctgaaacaatcgaacaaattaaagtttatggagcagcttatatcagagatttaatcactgtttatgatgacatggggttattatcattagacgaaaaaggaactgttaaaacatcaggtacagaaattggggctttcgtaagacttgatgatttagatgcaggttatagttttaaagaattagataggtctgttttcatgaatcctgataaagtcaatgctcgtatcgttattccaattacagaatataaagatgtagttgctaagcatgatgttgatatgttcttatatgcaaacaattatgaagaaaatggagattcattaagtttctttgataatgttgatgatgctcttaaagtctttagagctggtaatcgtatggcgaaaggaacaacaactgaatatggtttagtaggaagctactttgcaaatccatttggacctgtacaaagacaagatcaatgtgaaccattattacaagattatttccaacgtatgtttgatcaaggagttaaggttggacaattacgtactcgtttaggaattaaaggtaatgaacataatggtcctaaagaagcagctactgaaatcttaaaatatattacaggtgaaaaagaattaaaaatgttagaagatgatgaataatcatcttctttttttatattttatactatggaaaagaaaaaacgttggttaattaattttttatattatggaattatttttagtataggatgtttgatagtttatattttatttaaaaaatgtctgattgtcgttttaagttatttatccgctattttattaaaaccttttattgacttgatattagaaaaattgcatataaaaaataaagttttttcaataattatgacaatcatcatttttattcttttgtatacttgtttctttctctttgttttcttttcatgtcttttttttattaaaacactttcttttctaccaggctttatagaaacggtttatcaagaacttcttagccatcaatatctcatttctttttttacgcaattttatcaacaaattcaaactctcattcaaaatattctttcaacaagtattcattatgtattatcgcttgcgatgaatatggttcattttattgcttgtctgtttattcatttctttctaacaatactttttttatttcatcaatcacttattcaaagaaaaaaagaaaatctttatacgacccttatatcttcttttacagagacgtttattatcattataaaaacatatagtattttatttgttatcacatttatagggctttttttaggttttcaagtgataggaatcaaacaagcattgaatctttctttttttattgccttctttgacttttttccagtattaggaattgagatgattatgtttccttggatcattactcttgctttattaaatcaaatatctctatcattaaaactattaattctttatgggatcattgctctgataaggaatattttagaaccacatcttttatctaaaaaaatcaaaataccagctctctatatgtttgttgctatgtatctgtttatgaaattgatgggtatttggggggttatggttgcaccttttgttttgttagttttaaataattttagacaaaaaaataattttcaagagatttacaaaataattaaaaaaagtctttgaaatttatatatgttttgttataatagtcgtgcaacaatgtctaggatatgcgaatactcaacgtatagcttggatattgccaagaaattaacatatggaggataaaagaaatgttaacaaaacaagaaaaacaagctatcatgaaagaatatgctactaaagaaggagatactggttctccagaagtacaaatcgctgtattaactgcagatatcaacaaattaaatggtcatttcaaacaacatccaaaagataaacactcaaatagaggtttattaaagaaaattggtagaagaagagatttattaaaatacttaaaaaataaagatatcgaaagatatgcttctttagtacaaagattaggattaagaagatagttaaaaaagcgcctaagcgctttttttgttaaaagaataaaaggataaaaaaactctatgaaataggaatcatagagttttctttttattcaactgtaactgatttagctaggttacgtggtttatcaacatcacaacctttaagaccagctgcatagtaagcaatcagttgtaaaggtacagcaactaaaacagattgtaagattggatcaacgtcaggtaagatatatgtttctttaacatttcctacttcttgtccatcgattgtaaataagataacattcgcaccacgagcaattgtttcttgaatgttagaaattgttttagcagcaatatttggttgtgttgctacagcaatcactaaacttccttgttcaattaatgcaattggaccatgttttaactcacctgcaatataggcatcagcatggacatatgaaacttcttttaattttaaagctccttctaaaacagtagcataatctaaacttctaccaatataataagtatcttttaaatcttttaaataagatgcataatgttcaaatgttttttcatcttttaagatgttttcaatatgttgaggtaatgaagcaataccttcaataatacgtttataatcttcattttcatttcctaaagcttgagaaatatacataccaagtaataataagacaattaattgtgttgtataagcttttgttgaagcaacagcaatttcaggaccagcacatgtataaattgtatgatcagcttcacgagaaatagatgatcctaaaacgtttgcaactgcaattgttgtacagcctttttctttagctaaacgtaaagcagccattgtatcagctgtttctcctgattgagaaacaaagacacacattgttttttcatcaacgataggatcacaatatctaaattcactggcaacttgagtaaaagtagggattcctgttaatctttctaaaatatttgctcctgaaagacaagcgtgataagcagttccacaagcaacaaagtaagctttgttgaaagttttgaatttatcatgaatggcatcaagttcaggtaaaatgatacgatctgttccttcaacacgtcctcttaaagtttcagcaatagcatatggttgttcatgaatttcttttaacatgaatgtatcatatccacctttttgagcagcttcattatcataaggaatagtagtgatttctttttcgataggatttccgtattgatcaaagaaagaaacatttcctttatttaaaatagcgatttcataatcttctaagaaataaacatcttttgtataatctaaaatagctggaatatcactggcagcgacagaagcatcagctgtttttccaataactaatggactgtcttttttagcgataaagactttatcaggctcaattgttgaaacaatacataaagcatagcttccttcaattcttgtaataactctttctaatgctttttgtaaatttttttcttttttatagtaataatccatcatatgaacaacaacttcactatctgtttcagaatgaaattgatatccttgtaaaattaagatttctttaagttctctataattttcaataattccattatgaactaaagaaatagtctcatcattattagtatgaggatgagagtttaaatttgatgggattccatgagtagcccatctagtatgaccaatcccaacatgacctaaaacattttcatcttttaataaatcttttaaattttgaagacggcctttagctttttttgtaaataaatggtttccttcaattgttgtaatacccgctgaatcatatccacggtattctagtttttctagcccttgaagtaagaatggtagggcttctttgtttgcactaatggcagtaattccacacataaaaaatcctcctttatatatttatatgtgtggttataaaaaagaggataccagatgaatttgttttacaatcacttgtagtttttgttcatcgtttaggtagtatcatacctctagaccatccgccgaatttttcgataagtctagtcctcgtcaactgcaatgcagtcctggcgctctattttcaaatctcattttataaccgcatctattatatagagtacttatttataaatcaactacaaattttttaaaaaaagaagaaaaaatgattttttttggcgatataataatggaggtatttttatggaaaataaaaaaagtgagatgtctgtagaatataatatggacgaaatgaaaaaatcattaaaaaatttgaaagaaacagaatgctatgatgtagaaaagtatacctattctttattgcatcaaacaagacaattagagtatttttattgtcaattagttgaagaagagaatccagaacctgatcaaacttattatcatgtttctcgtcgacctatggttcaccaaatggcctattttaacattggtagaggattccctaaagaattgatggatgggcattggtgctacgttttaaaagattttgggtcgaaaatgctcgttattccctgtacatctattaaagaagattcgccagaagcaactgaatatgaattagatattcgtgcaaaaataagaaaatatccaataaggagtcgtatgcagttgagtgatatgcgtgttgttgatcttcaaagattagatattagaaaaagattttgcaatgtaattacggataaaaaagaaatagaaaatcacataaaacatattatttttgatgaagatgatgaatattaaaaggtctcacgaggagacctttcttttatcttataaatttaacaatctcttagtatctctagcgataactaattcttcgtttgttggaataacgtaaactttaactttactatttggcgtagaaattaaacgatcacctttaccattaacgtttgcatcatcatcaatttcaatacctaaagcttcagctaataaattacaaatttcttttcttgcaaagaatgagttttctccaatacctgctgtaaagcaaatagcatcaactccacctaaagcaatgaagtaacgaccgatataagcaataactcttctaaagaaaatatctaaggcaagttgcgctctttcattaccgttggcagcagcttcttgtacatctctaaagtcacttgatacaccagaaacaccaagtaatccagattctttattaagcatcttgatgacttctttcatatctaaaccaacttcttcgattaaataatcgataactgaaggatcaacatctccagaacgtgttcccatcataataccagcaagaggtgtaaatcccatagatgtattgattgatttaccatctttaacagcagttaaagaaccaccagctccaaggtgagcaacgataatacgtgagtgtttagggtatcccatcatttcacgacaacgagatgaaacatagaaatggcttgttccatgagcaccgtatttacgtactttgttttctacataatatttgtaaggaattggataaatataactttttggttctaatgtttgatggaaagctgtatcaaatacagcaacagctccagcattaggaattgcttctttaaaagcataatatccagttaagtgagcagggttgtgtaaaggtgctaatgattttaattcatcaattttagcaactacatcatcatcaaggattactgattgatcaaaataagctccaccttgaactacacgatgacctacacctttgatttcgtctaaatctttaacaatttcttttttgattaaagtgtctaataaaagttgaacagcaactttatggttttcgattggtaaagttgtgacatctttttctccattatacttaatagtaaaaatagaatcttctaaaccaattctttcaataacaccagaagtaataacagtttcatcatccatttcaaataattggaattttaaagatgaacttccagcgtttacggaaataatttttgacataatattcaagtcctccttattaatacttttccattataacaccgacaaggaagaaaaaactataaaaagattgaaaaaaagaagagattgatttatagtaagacttgccaggggcgcaaaatgctgagaaaggtgaaaaccttgtcccttataatctgaactaggtaatgctagcgtagagagtgcaaaatagtttatttgcctttttgcgtatgtaaaaaggtttttattttgcctcatttaaaggaggatgactatggaagttaaattaactacgaagaatatggcttatatggcaatgtttgcggcaatgcaagttgttttagaatattgcacaaaattttatgagatgccaaaaggtggtaactgtgctttttcgcttgttgcaattattttatgtggctatttgatgaattggggttacagtttgattgtttcacttgtttgtttaggtctacattttgctttaggacttgcaacattttatggtcctttatcggtaatctttgattatttattaccaatggttttaattggacttacaccacttattcctttattaaaggtgggtaagtatgaactacctgttggaattatcgtaatgggtgttttaaaaacgatttgtcatttgatttcaggatggtatgctttccaaacaccattacaagcaaacttaacttataacttaccttataatattgcaacaatcattgcttgctttattttgtttgtgattttatatccaaggcttaaaaaagcagttcatttataagactcgtttcgagtctttttttctttgaaagaaagatgaatttgtgtataatgtaaatgttaataaggagtcgtttgttgtggaagatattgtaggaaagaaaatcttaatacatggatataaacataatggtaaaatacatagatgttggtcaaagggacttgttttacaagaaacggatgatcattacattgttattaataatcggacattggtgacagaatcagatggcagaatgtggcatacacgtgaacctgctatttggtatatgcccaaacataaatggtacaatgtcatttgtatgattagaaaaactggagtgtattattatagtaatattgcttcaccaactttatatgatggagaggctttaaaatatattgattatgatttagatttaaaagtatttccagatggaaactatcgtattttagatcaagaagaatatcgtcaacatgctcgtgaaatgggctatagtgatgaattagacaaaattttaaagaaacaactagatgttttgattgatttagcagtaaaaaagggaggaccatttgatcagaattttactaagaaatggtatagtttttatcaagatttaaaagagggttattatggaaaaagtgattactataaataatagagatgaaacattagtttttggtgaatatttaggaaaattactaaaaccgcatatgttattgacacttaatggtgatttgggtgcaggcaaaacaacctttactaaaggaataggaaagggtttaggaattaaaagaattattaattcaccaacttttacaattttaaaacaatatcaaggaaattatcaattatctcattttgatgcttatcgtttagaaggacaaagtgaagatttaggctttgaagaaatctttgatagtgacgatatttgtgtggttgagtggccagaatttttagaagatattttacctcaagaacgtttagcaatgacgataaaaagaatcgatgatgatcgtagagaatttattttaaaaccaattggtaaaaaatacgaagaacttgtaaaggagattgaatatgaaaacaattgtcatggatagtgctaataagtatttagtagtagctttatatgaaaatcaaaaatgtttagcttctttacaagaagaaggaaatcgaaagcaatctgagaatgcaatcgtttatttacaaaagttattacaagaaaattatttaaaaatgagcgattttgatgaaatggtcattactattggaccgggttcttataccggtgtacgtgttgctttaacgattgcgaaaacattaaatgcaacgatgaatattaaggtaaaaactgtttcttctttaaaggcgatggcaggaatgaaaaaagctatttctattttagatgcaagaagccataaattatttctaggaatttacaatgaaggaaaggttattgttgatgattgtttaataaatattgatgaatttgaaaattatcaaaaacaatatagtgattatgaaattgttggtgatacacatttagtaggaatacctgaaaaagaagtggatcttgccgatcatatttatacactttctactttagaaaaagaaatagaaaatgttgatggtcttgttccaagatatattaaggaagttgaggctaaaaaaatatgtcaataagagaaatgaaagctgatgatttaaaaagaattgtagaattagaaaaagatctttttttatcaccatggaatgaagaagattttatacatgaattaaaagagaatcctatggcgggttattatattcttgaaaaagaaaatcaaattattggatacataggattatggtttttaggtgatcaatgtcaaattacaacaattgcgacagatcgacattttcaaggacaagggtgtgcaagccaactgatggaatacgctcttgaaaaaagtgaagaattacattatcaaaatgttaatttagaagtacgtgtttcaaatgtaaaagcaattgctttatatcaaaaatttgggtttaaaaatgttgctgttagaaaaagatactatagcaatggtgaagatgcgtatttaatgatcaaggaattggagggatagagatgtcattattactagcaattgaatcaagttgtgatgaaatggcgatggctgtcttaaaagatcaaagagaatttttgagtagtgtcgtggcaagtcaaatcgacatacatgcaatgtatggtggtgttgtccctgaaattgccagccgtaagcatgttgaatgtgtatctgttgttttaaaagaaacgttaaaacaagcaaatataaaaatggaagaccttgatgctatttgtgtaacaaaaggtccagggcttgttggctctttacatattggtttacaagttgctaaaacactttctttggcttatgataaaccattaattggggttcaccatattgcagggcatatttatgcaaataattatgaaaaagatattgtttatccaacactatgtcttgtagtcagtggtgggcatacagagcttgtcttgatgaaacatccttattcttttgaagtgattggtgaaactttagatgatgctgttggagaagcatatgataaagtgggaagagttttaaatttaccttatcctggagggcctgttttagataaaatggcacatttaggaaaggcaagttatgctttacctaaaccgttggatgatgatagttataattttagttttagtgggttaaaatcagcggttattaatttagcacataatcataaacaaaaaggattagaaatcaatcaaaatgatttagcaacgtcttttcaaaatgttgttgttgatgttttggtcgataaaacgattcgagcggctaaagaatatggtgttaaagaaattatgttagctggtggggtttctgctaataggggtttaagagaaaagatgaaagagcaagttgacatgttagaagacgtacaattgtctcttccaccaatgaaatgttgtacagataatgcaatgatgattgctttagcaggaaaagttatgtatgataataataagtttagtgatttatcgcttggcattaaaccacatcttgatttagaattagaatcaataggaggggattagtgtggagaaaaaaatatcaaaagcgacaatgtcccgttttcctgtttatttaaaagcgcttagaaaaatgcaacatgaaggaaaagaaacatgtttatcgagtgaattgtttgaaattacaggaatacaagatacaacaattaggcgtgattttacatatttatcaaaaacggataattttggtagacgtggaagaggctatgatgttaaacatcttatagatggtttaagtgaagttttaggtttaggattagatgaacctattattttaattggggttggtaatttaggaagtgccattttaaaatataatcgttggcaatatacagtaggtaagattgtttgtggttatgatatggataaaaataaagaaggggaaagatttggtgtgaaaatttgtcatattgacaagttggaagaaacttttccaagtgattgtaaaattgctattttggcgatttcagaaaatgttcaagaaacagtggatcgtttaatgaaattaggcattaaaggaattgtagattttacgcatagtcattttatggttcaagaaggcgttgaagtccaaacagtagatgttgtggtagctattcaagaattagtaattaaaatgaaatcaaatgatcaagaatagggagagaaaaatgtttgaatttattacagtaagagaattatatgaattatatatcaatgatagaaatcaattagatggtattgaatatgttgaattacaaggatggatccgtacaaatagaaatagtgggaaagtcggatttttagctttaaatgatggaacatattttaaaaatgtacaagttgtttatttagatgaaattattgataattatgaagaagcttctcatatttctacaggaagtgctgttaaagtaactggtaaattaaaattaacaccagatggaaaacaaccttttgaaattgaagcaacacatttagtggttgaaggaacttgtgatgaagatttcccattacaaaagaaaagacattcttttgaatacatgagagaaattcctcacttaagaccaagagcaaatactttttatgcaatctttagattaagatctgttttatcgatggctattcatgaattcttccaaaaccaaggattcgtttatgtccatacaccaatcattacttcaaatgatggtgaaggtgctggagaaatgtttagagcaacaacaatcgataatactgaatttgataaagatttctttggaaaagaagcttatcttacagttacaggacaattacatgttgaagcttttgctttaacatatcgtgatgtttatacatttggacctgcctttagagcggaaaattcaaatacttcaagacatgctagtgaattctggatgattgaacctgaaattgcttttgctgacttagaagatgatatggatttaattgaagatatggttaaatactgtattgattatgtcttagataatgccccagaagaaatgaaattctttgaaagcatgattgataaagaatgtatcaaacgtatcaaagcagttagagatagtgattttaaacgtatgacttatacagaagcaatcgattatttattaaaagcagatgttaaatttgaaaataaagtagaatggggtatggatttaaattcagaacacgaacgttatatctgtgaaaaaattgttggtggaccagtatttttaacagattaccctaaagaaatcaaagcattttatatgcgtttaaatgatgatggtaaaacagtagctgcttgtgatttacttgttccaggaattggtgaacttgttggtggatcacaacgtgaagaaagatatgatgtcttagaaaaaattatggatgaaaaaggaatggccaaagaaggattacaatggtacatggatctacgtcgttttggtggatgtaaacatgctggatttggtttaggattcgatcgtttcttaatgtatttaacaggtatgcaaaatattagagatgttgaaccattcccaagaactccaagaaatttaaaattctaaaagcctattcgttaggcttttttttgtgtataatatgtgggaggtgacacacatgaatgaatatgatttgatgaatctctattttaattttatttttaaagacggtaataagtcatttaggtatgtgtatgcaagttatgaacaacttgtagaatttaaaaattggttaacaaaacaaaatataaaatttccatttgtacatcaaattcaaaaaaatgaatgtgagttactttttagaagtaaaaactttgaaacctatgatacggcttttaaaacaagttatgcacatgattttcataaatatatagcaaaggaaaaagaaaaatatcaagtcattttattattgggaatcgatcagcaattctttgaaaattttgataatagttataatcatgatttgatgcgcgtttttcgtataaaaaaggcattgaaagaagatatctctttatatggaccttttcatctgtttttaaatgctctttatcaaatagatcgttggccgggtgtttttatatttaaaggagagcaaagtgttttttatcctgtaaaaaacatagaggaagtaaaagaatgttttagactaatagaaacaaataagatttttgaaaagaaatgtcaaacaaatgaagatcaatattttatacaactaagcgatcttcatttaggaacaaagaaaacagacaatggacttattgtattacaggatagtctagatgaactttatcatatgcttcctcatgatcatcaacttaaatttttgattacgggtgatctaatgaattcgcctaatcgtaaaaatatgtatgcagcctctcattttatgaatcgtttaaaaaggaaatatcatagtgatgtaacgtttgttttaggaaatcatgacgtcattgtttatggcttgaatcttttaaaaaaacaaaagacaaaagtggtagcttatttgctaggagaaaatattaaagtttatccggatgttaaaatgattgtgatcaaaatagattctacttctcaaggaaatctagcaaggggaatggtcgggcaaagacttttacaagaaattgaagatgagttattatctattaatcatttagaggattatactttgattgctatgatgcatcatcatttaatgccacttagaaaagatgattttttgaaaataaaatggaatgaaaaactattcatgggaaaaattgctgactcgacaaaagcccttgtggatgctcaagatgtaatgtattggttagaaaaacatcatgtacgttatattttccatggacacaagcatattccttgtgttgtaaaaaaaggaaatacgtatattatggcaggaggttcttcttgtggaggaggtaccagagaaagaaaaagcagttatttaagttataatttattgaaatataatcgtaaagatcaagtgtttaagtattgttttgtattctatgatgatcttacaaaacaagaaagacatcgtgtaaaaataaaattatttatggaggatcaaaatgaagttagtagataagatgaaagatgaaaatttaggacttgcaatcctatataactttacaaaagggtatgggcatgttccaatgagtgtttatgatgtggttttaccatttctttatcatgatggttttagaaatcatttatttgaagggattgaagtagaagaagcccttactaaatgtgttcaagaggatgcttcttttattcaaaatatattagatacaattgaaaaagataaagaaatgacatcaagagcattaggaatttgtcttttaaataaatatttaagttttgaatttgaagataatgaaatgaaagggatttatcatgaaagctctattttagatattaatgaagcaatcaatttaggaaaattcttttcaggaaaatcttatgaagatattttaaatattttaaaaaaaaagagttctagcgttgtctttttagatagtgtttgtttaggagatgatgttgatctttctaagttgaatcaatttggacaagtaacgatttataaacaaagtaatccagaagaagtcattgaacgtattaaagaagcagatatcattattacgaataaatgtttacttaccgaagaagtcttacaatatgcttcgaaagtaaaacttatttgtattacagcaacaggtgtcaataatgttgatttaggttattgtcatcgtcgtggtattacggtatgcaatgtggcagggtattcttctttaagtgttgcgcaacatacttttgctttagctttagaacttttacataaaaatagttattatcatcattatgttcaaagtggtcaatatagtgaaagtggtatgtttagttatattggacctcgtttttatgaattacatgaaaaaacatggggtattattggtatgggaaatattggacgtacggttgcaaaaattgctgaagcttttggctgccaagttcagtattattcaacaagtggaaataatacgaagcaagattatctctcagttgatttagaaacattattaaaaacaagtgatattgtttctattcattgtcctttaaatgaacaaactaaaggattaattggtgaagaatcatttaagttaatgaaaaaagaagcgattttaattaatgtaggacgtggtggtattgttgatgaagaagcactggttgaagctttacaaaataatgaaattgccggggcaggactcgatgtttttgaaagagaaccacttgcaaaagagagtcctttactacaaattaatgatgcttcaaaacttttaatgacacctcatattgcatgggcaacagtagaagcaagaaatcgtttgtttgatttagccgttgataatattcaaggttttttaaagggtgatttaaagaatgtatgttaatgcattctttttttgcaatttaaaatgaattatgttatactcgaaaaacttgaggagaaaatgaatgaacaaatttgaaaaattaggattaagtgaagaattattaaaatcaatcaatgaattaggttttgaaaaaccaacacctattcaagaaaatattatccctgttattttggaaggctatgatgtcattggacaagcacaaacaggaacaggaaaaactttggcgttttcaagtattttacttacaagtttaaaagaaagaaaaaagaaaccacaggcgtatattttatcaccaacaagagaacttaccatgcaaattcatgaagaattaaaaaaacttggaaaatacagttctttacgttttgcttgtgtatatggtggtagtggtattgaaaaacaaattaaatcgattaaaaaaggtgttgatattgtcgtaggaacaccgggaagaatgatggatttaatgagacgtaaagtccttcaactagatgaagtttcttacgtggttttagatgaagctgatgaaatgttgaatatgggatttgtagaagatattgaaacgattatttctaagacaaatccagaacatacaacgatgttgttttctgcaacaatgccagaaggtattaaaaaaattgcgaaaaattatatgaaaccagattataagcatattcaagttaaacaaaaaacagtgacagctaacacagttaaacaatattactttgaagttaaacaaaaagaccgttttgaaacattatgccgtattattgatagtgaaacggtacaatcaggaattattttctgtcgtactaaaagaagcgttgatgaagtaacggaacaaatgcaaaaggctaactataatgtagaagcaatgcatggtgatttaaatcaagatcatcgtatgcgaactttaaagaaattcaaagagggaacaattcattatttaattgccacagatgttgccgctagagggattgatgtagaaaatattagccatgttatcaattatgaattacctcaagaagtagatctttatgtacatcgtattggtcgtacaggtcgtgcgaatcgtgaaggaaaagcctatacaattgttgtaggaaaagaagaacgctatttaaaagagattgaaagaaaaacaaaatctcatattgaaaaattagaagtaccaacattaacacaaattcaccaacataaagtaacagaattaatgtataaattagaagatatgattttacatggagaacataaaccaatgaaagatttggtaaatcaaattgaaaatcatatgttaaaagatgtaacggcagctttaatagaattatctttaaatcaacagattggttttccttatacgaaagaaaaacttgaatcttcatcaaaacgtaaaaaaggtgcaagtgaaggttatacacgtttatttttaacggtaggatctatggataaagcaaagaaaaaagatattattcatttcttggtctcaaaggcaaatattaaagaaagtgatattcaaggaattgatattaaaagaaagtttacgtttgtaaatattaatgataaagctgtaaaaaaagtgatgagacattgtcaaaaagaaaaattaaatggacgaaaagtagaaatagagcaagcaaatagccgttaggctgtttcttgttcaattttttttaaaaaattaaaggcgatagaatcaacataattaataaaaattatgaaagcggtatcaatttacacttgaatgtaagggctatcatgtgtataattatattagttgattaattaggaggattgattgaaatgaaacaatatgtttactcattcaaagaaggaaataaagatatgagagtcatccttggaggtaaaggtgcaaacttagctgaaatgacaagcattggtttacctgttccacaaggatttactgtatcaacagaagcttgtactgcttattatgaagatggaaaacaaatttcgcctgaaatttgtgcgcaaattgataataaattagctgaattagaagctgaaactggaaaaaaattaggagatccaacaaatccattgttagtatctgttcgttctggagcaagagaatcaatgccaggtatgatggatactgttttaaacttaggtttaaatgatgaagtagctactgggtttactaaaattacaaataatgaaagattcgtatatgatagttatagaagattcattcaaatgttcgcagatgttgttatgggattcccaaaaagctcatttgaaagaaaatttgatgatatcaaagaagaaaaaggagttgaatttgatacagatttaactgctgaagatttaaaagaagttgttgctatttataaagaagaatacaaaaaacatgcgggagttgaattcccacaagatccaaaagttcaattaatggaagctatcaaagctgtattccgttcatggaacaatgaccgtgcaatcacttatagacgtttaaatgatattcctggttcatggggaactgctgtaaacgttcaacaaatggtttatggtaatacaggagatacttctggtacaggtgttgccttcactcgtaaccctgcaactggtgaaaagaaattattcggtgaatacttaatgaatgcacaaggtgaagacgttgttgctggtattcgtacacctcaaccaattgcaacattaaatgatgttatgccagaatgctatgaacaattctgtaaagtatgtgacattcttgaagaacattatagagatatgcaagatatggaatttactattgaaaatggtaaattattcatgttacaaactcgtaatggtaaaagaactgcacaagccgctttaaaaattgcagttgatttagtaaatgaaggaatgattactaaagaacaagccttattaaaagtagaaccaagacaattagatcaattattacatccaaactttgaagaaacttcattgaaatgtgctcaagttgtagctacaggattagctgcttctccaggtgctgcaacaggacgtatttatttcactgcagaagatgttattgaagctcataaaaatggtgttcaagatatcttattagttcgtcttgaaacttcaccagaagatatcgaaggtatgaatattgctcatggtatcttaactatccgtggtggtatgacatcacatgcagctgtagttgctcgtggtatgggtacttgctgtgtgtgtggatgtggaagcttaagagttgatgaagaagctaaagtattaatgacaccagatggtaaaaaatatcatgaaggtgactatatgtcattagatggaagtacaggtaatgtttatggtgaaagaatcaaaactgtagaacctgaaatcagtggtgactttgaaacattcatgtcatgggctgatgatgtacgtacattaaaagttagaacaaacgctgatactccaagagatgctttacaagctcgtaaatttggggcagaaggtattggtttatgtagaacagaacatatgttcttcgaagaagaaagaattttcaacttcagacgtatgattactgctgaaacagtagaagcaagaaaagaagcattagaaaaaatcttaccatatcaaagatctgactttaaagaattatttaaagcaatggaaatctatccagtaacaattcgtttcttggatccacctttacatgaattcttacctcatacagatgaagaaatcagacctttagctgaaagtttaggtatgacatttgatgcgttaaaagcacgtgttgaatcattaaaagaattcaacccaatgatgggtcatcgtggatgccgtttagcagtaacttatccagaaattgctgaaatgcaaacaagagctgttattgaagctgcaattgctgttaataaagaaggacaaaacgttgttcctgaaattatgattccattagttggagatattaaagaattaaaatatgttaaagatgtcgtatgtaaaacggctgatgcaattatcgaagaagcaggtgttgaattaccatataaagttggtacaatgattgaaattcctcgtgctgcattaactgcagatgaaatcgcaaaagaagctgaattcttctcatttggtacaaatgacttaactcaaatgacttatggattctctcgtgatgatgctgctaaattcttaaatgaatattatactaagaacatctttgaatctgatccatttgctcacattgatgaaaatggtgttggacaattaatgcaaattgctattaataaagctaaaccagttcgtccagatattaaactaggtatctgtggtgaacatggtggagatcctagaactgttgaattctgtcatagaattggtttaacttatgtttcatgttctccataccgtgtaccattagcacgtttagctgctgctcaagctgctgttaaagaaaaaatgggtaaatagtttataaggagggtagtgaaaactactctctttttatttgtgtgaaattcaattattgaagttttctttttttagtgaaataataaaaattaggagatgataaaatgacgtatgaagaaatgatagaagatgaaacttttattgagggaatgcaaacacgtatcatatctgatcaagaaatggatactatgtatattccggatgttgaatatatgaatattgatggaatcagtcgtgttttacaaatattagtacctcgtaaaagggtgatggaaaatgaaaaatatccactaattgtctatgttcaagggtctgcttggcataaacaaaatgtttatcaacatgtaggacaacttaattatttatgtaaacaaggttttgttgtagctattgtacaatatcgtgaaagtgatttagtgccttttccagcacaaatagaagatactaaaacagcaattcgttttttaagaaaacatcacgaagaatattttattgatgaacaaaatgtttttttatttggtgattcatcgggtggacatgtagctttagtaagtggacttacaagtaaattaccattatttaacagtaatttatattctgaatattctaatgaagtacgtgctattattgatttttatggtgtggttgatattacgatggaagatggcttcccaacaacagaaaatcatcaacaacccgatagtccagagggatatttaattggaagaaaaaatgttttagaatatttagatatcgctcgccaaacaagtccaatgacatatttagatggtgatattccacctattttaattgctcatggaacaaaggatcgtttagttgcgtttaaacaaagtgttaaactttataaggctttaaaagataaaaataaagaagttattttttatcgtatgaaaggggcagatcatggtggacctatgttcttttgtgaagaaatgcttgatgaagtaattaaatttataaaaaagagcgtagctcatgattaataaataggaatatggtaaaatattattattagaggaaagaatattttaaaaaatattgataaacaaaaagtattaaaattaaaataagaagttgcttatcaaaaaggacaagttgtttctaaaacattagcacaaaatgaagcgttaagtgtaactttttttcttttgataaaggagaagaaattagttctcataaaagtggtggagatgcttttgtgacttgtttggatggtgaaggagaaattacaatcgatagtgtaaaatatattttacatgaaggagaatcaattgtaatgcctgctgggttaccacatgcagtctatggaaaagaataatttgaaatgttattagttgttgtcttttaatgattgctatgatgaaatatcatcatagcttttttttatgttaagattggtctataataatcataaaggtgagtattatggaaaaaataatgttgaatttaaatagtttggcaacgatgttatgtacatgtgatttatatgcatatgatgaagctgctttaacaagtgacgagtggttggaagtcgaaaaaaatttaaaagttcatgggttaaatggtcccggcagtctttttgggttaaatagtgatgaattaatggacatattagatatttctgaatatagtgcatataaaattgtgcgacgaatgaaatcgatacagttttttttaaaaaaattgcatgaatatgaacaacaaggaattcgtattattactaaatatgatgaagagtatcctcaaaatctaatcaagaaaatgaaaaagagtgcacccctttgcttatttattgcaggaacattaccggtgaaatttgaaggtatttctattacgggattgcaaacagtttctaaaaaagaaaaaggatatgttaaacgacttgttgataagctcaataatgaagataaatggttaatttctaatgattgtaaaggaattgatcaagaggcctttcattatggattgcatcatcatagtcaaataatttgctttgtttgtgaaaatatgctaaataaaatacaagaatataaaaagagtattagaatggggaaggttgtttttttaagtgctgttgatcctgctaaaagatttactgttactcatgccattgatagaaatagttatgtatgtgctttgtcaatgtttcaaattgttgtttcaagtaaaataaatagtggtgctacttggtttacaatcatgcataatatgcatcataattggactgtttcattggttcttgataatgattgttttggaaatcaaagactactagaaatgaaaacagtaccgatttatataaaaaatattgtttcagatacaagttttgagatgatttatgaacttaataaaaaagaaaatatagaagaagttaatattgatcaaatgtcaatatttgaatttataggagatacgaatgaatcgagaatataaaatatataaaattacttactttttgatggctgtgaatgttattacatatctgtatacttcgttaaaatatggtttatcaatgtccgctatgcaagggatacaagttggaggttttaatcctttgtatgtttattactatcatgaatattaccgattgattacagctaattttattcattttggtttaatgcatattttttgtaatgtttattctttatataatttaggaatgttaatggaaaaaatattaaaagagaaaaaatatattatcgttattgtagtttcgatgatttcgacaacattattttcttatttgttatttttattatttaatattggtacaaatagtgtgatgggtggtatttccggtgttgtttttggacttattggttcgcttttagcactatcagttttatatggtgatgtgtatagctatttgtttaaacaaattgtttctagtgttgtattgatgctttttatttcggtggctgttccttcgatttctttagtgggtcatttgggcggaatgattggtggatttattgcaacgtttgttttagaaaagatagattcaaaaaaagaaagaataataaattagggggggatataatgaatttacaagaaaaatacaatgaatataaacaaaggcaagaggccaaaaagttttttaatcaaaataatgattatcatttatcaataagtgattatataaaaatgtttgttgttggcacagtaattgctattttttcaacaattgcttttgattttattagtttacaaatagggtggagcttttcatattttgatattttaacaggttattttacaggttttattgttttaaaaatagcgcgttatggaagcgaaaaagttgggatcatttcagtgatatgctatctacttggaacgctgtttacaccgatattgacatattatgctttttggggtcaatctcttactttggtgatggctattcaattagcgataggacagtttagcaatcttttttctttagtttttatagctattggagcaatgacagcgtatataacaagtaaaaattagtaggactataaggtcctattttttatttttgatagaaatagtaagcgaattcatgaattcgtgtagtcaaaatgtttggaaagtagtataataatagaagcaaaaggaggaattttttaattatggctaagaaatatttgtcaatggatgggaaccaagctgctgctcatgttgcatatgcattttctgaagtagcaagtatctatccaatcacaccttcatctccaatggctgaacatgctgaagcatgggctgcaaatggaatgaagaatatctttgggtctcctgtgaatgttattgaaatgcaatcagaagcaggtgctgcaggtgcagttcatggggctttacaaggtggtgccctagcaactacatttactgcatctcaaggattgttattaatgatcccaaacctttataaaattgttggtgaaaatttaccaggtgtattccatgttgctgcacgtgctttagcaactcgttcacttaatatctttggggatcatcaagacgtgtatgcttgtcgtcaaacaggtattccaatgatttgttcacactcagtacaagaagtaatggatttagggggagttgctcacttaacagcaattaaagggtctgttccagtaatgcacttctttgatggatttagaacatctcatgaaattcaaaaagtagaagttatggattatgatgtattagaaagcttattagataaagaagctttagctaaatttaaagcaaatgctttaaatcctcatacaaatccaattgaacgtgggggagctgaaaacgatgatatctacttccaaggtagagaagctcaaaataaacatatcgatgcagttgtagaaatcgctgctgattacatgaaaaaaatttcagaagtaacaggtagagaatatgcaccatttacttattatggtgatccaaatgctgatagagttattatcgctatgggttctgttactgaaacaattaaagatacaattgatgaaatggctaaatctggagaaaaagttggtttagttaaagttcatttatatcgtccattctcagcaaaatacttgttaaaagtattacctgcttcagttaagaaaattgcggtattagatcgtacaaaagaaccaggatctgctggtgaaccattatacttagatgtatgcagtgttgtaaaagatgcggatgttttaattggtggacgttatggtatgggttctaaagatacaaatcctgctcaaattaaagctgtttatgatcatttgaattctgataatccattcaatagttttactattggtattgttgatgatgttactcatttatcattaccaactgaagaatttaatgtaacaggtgactatacagaatgtctattctatggtttaggatcagatggtactgtatcagctaataaatcatctattaaaattattggtgatcatacagatttatattctcaagcttactttgcttatgatagtaaaaaagcaggtggaacaactcgttctaacttaagatttggggcttcaccaattcgtgctacatattatgtaaataatgcagactttatctcatgctcattagataattatgtattaaaatatgatatgttgaaaaacttaaagaaaaatggttcattcttattaaatacagaattttctaaagaagaagttgctgactatttaccaaatagagtgaaaaaacaattagctacaaagaatgctaaattctatattattaatgctaataagattgctatggaaattggaatgggacgtcgtacaaatactattttacaatctgcattctttgcattaaacccacaaattttaccaattgataaagctgttgaatatatgaaagaaatggctaaaaaatcttatagtaaaaaaggtgatgccattgttcaattaaactacaaagcaattgatgctggtaaagatgcaattgaagaagtaacagttgatccaaaatgggctgatttagaaatccaagaaactaagaaattaacaggtgatgatcattttgataatttcgtttctgtaatcaacgcattagatggtaatgacttaccagtttcagcattcatggataaattagatggttctatgaaatctggaatggcttatatggaaaaacgtggaattgcgactatggttcctcaatggaataaagatgactgtatccaatgtaataactgtgttatggtttgtcctcatgctacaattcgtgcgttcttaatgactgatgaagaaattgctaatgcaccagaagatatctctaatgatgttttaaaacctatgggtaaaggggttgacggattatcttatagaattcaagtttcaccagataactgtgttggatgcggtttatgtgttgaacaatgtttaggaaataaaaaaggtgaagctttaaaaatggttaatgttcatgaagaattagaacatgctccattagctgattatatctataaagaagtagaatatcgtgatgataaatatcctacaactactgtaaaaggtgttggattcaagagaccatactttgaagtatctggtgcttgtccaggatgtggagaaactccatattatagattagcaactcaattatttggatcagatatgatgattgcaaatgctacaggatgtagttcgatttattctggttctacaccatctacaccatttacaactgataaaaatggtcaaggtccagcatggtgtaactcattatttgaagataatgctgaatttggttatggtatgaaattagctcaaaactataatgaagctcatatgattcaagtaatggaaaatgctaaagatgcttgtgaacctgaattaaaagaaactattgaaaaatacttatctgtaaaaggacaaagaagcgaagaaaaagcaattgttccagaattattaaaattagttgaagcatcttcaaatgatgcgattaaagaagttttagataataaaggtaacttagtttctaaatctcaatggattgttggtggagatggatgggcttatgacatcggttatggtggattagatcatgttatcgctaataatgaaaatgttaatattttagtattggatactgaagtatattcaaatacaggtggacaatcttctaaatcatctcaagctggttcaatcgctaaatttactgctggtggtaaaacaggagctaagaaagatttagcgcaaattgctatggcttatggtcatgtttatgttgcacaaattgctatgggtgcaaatcctgcacaaacaattaaagcaatgaaagaagctgaaagctatgatggaccatcattaattattgcttatgctccatgtcaagcacatggtattaaaggtggtttagcaaatcatcaagctgaacaaaaacgtgcaattgattgtggatatttcaacttattaagatatgatccaagattagaagaacaaggaaagaatccattacaattagattctaagactccaaactttgatggatttaaagattacttattaggtgaaaacagattctcacaattattaaaagtaaatccagaacatgcagaacaattaatggctaaatgtcaagctgatgcacaaaaacgtcgtgctcgtctagaaaaaatggctcaatagttaaaatgaaatccatttggttaattccaaatggatttttttgtagttattaaatataaaataatcgatttttaaaagtaataaatttattctttagtatctaaaatgctctataaacaccaaatcataaaaaagcatcaaaaaagatcaatgaaaaaaacgttgatataaaggcagaaaaagagggaaactgctctaggaagggtaatggcatacccctaacttgcactgcgacctatcagaaatgaactggtcagccaacaatgttaacaggtagcaagaatcccctgtctttagacatggggagtgtcaaaacaagaatatttagtgaatgtagtatgttagaatgtaataaagatcttgaactttattatttagattcttttaaaatagtacatgaaaagtagactctttataaaagtctgctttttaaattacatttttttggtgtattcttaacaataaaaagagtaaaataggctttggaggtgagactatgttgttgttaggacatagaggttatagtgatcaatattctgaaaatacaatgttagctttttcaaaagctattgaaagtggatttgatggtattgaaacagatgtgcataaaacaaaagatggtgttcttgttttatgtcatgatgaaaaaatcaatcgaacaagtgatggaaaaggttatattaaagatatgacttatgaagagctttgtgcatataattttggaacaaaagaaaatcctcaaagaattcctttgttgaaagaattattggaattatgtaaaggaaaaaatgtaaagatcaacttagaaattaaaacaaataaaattcaatatccaggaatagaactagaaagctatcaaatgatcaaagaaatggggatgctagatcaagttttattttcaagtttttatgttgattctctttataaattaagagcaattgattcatctttatatttaggttatctttttgaagatgattatgaaaaaaataaacaattatgtttaacacaaaaatttcatgtacatgcacgtgaagattttctagatgaagatgaaattgcactctttttaaaagctggattagacatcaatacatggggtgtaaagaaccgttttagatatgcttattttaaggaaaaaggtgtcaatattgttattgcaaataaaaattttaagaaattaaaaatgtaatcgcttacgttattttttcacatcaaacaagcgataatgcttgttttttgtatgtttttcatgtaagatggttgtgtacaaatgaaaaatttcacaatagttatggaggaaataaaatggcagaaaaaaaacccgtacaacaagctgtcccaactgaagcagaaactgatgctcatgttgatgaccttgtaaacaaagctttaaaagctttagaagaatttgaagattttacacaagaacaagtagactacatcgtcgctaaatgttctgtagctggactagaccatcatggtattttagctgaagctgcagttaacgaaacaggacgtggagtatttgaagataaagctgttaaaaacttatttgcatgtgaatatgttactaacaatttacgtcatttaaaaacagtagggatcatcaatgaagatccattaactggtattactgaaattgctgaaccagtaggtgttgtttgtggtatcgttccaacaactaacccaacttcaacagtaattttcaaatcattaatcgctttaaaaacaagaaacccaatcattttctcgttccacccaagcgctcatgaaagttcaaaacaagctgctatcgtaattagagatgctgctattgctgctggtgcaccagaaaactgtatccaatggttatcaattaaatctatgtatgctactaatgcattaatgaatcacccaggtgttgcaactatcttagcaactggtggtaacgcaatggttaaagctgcatattcatgtggaaaacctgctttaggtgtaggtgctggtaacgtacctgcatatgttgaaaaaacatgtgtattaccaagagctgtaaatgatatcgtattatcaaaatctttcgacaatggtatgatttgtgcttctgaacaagcagcaatcgttgaccaagaaatctacagtgatttcatgaaagaaattaaaagattccatgtttactttgtaaataaagaagaaaaagctaaacttgaaaaattcatgtttggtgcagaagcttattcagacaatgttgctcaagctaaattaaatccaaatgttgtaggtaaacccgctgaatggattgctgaacaagctggattcaaagtgcctgctgaaacacaaattatctgtgctgaatgtaaagaagtaggaccaaatgaaccattaactagagaaaaattatctccagtattagctatcttaaaagctaaaagcactgatgatggtatcgctaaagcagctgcaatggttgaatttaacggtttaggtcactctgctgcaattcatacagaagatcatgaaatttctaaaaaattcggacatgcatgtaaagcaatccgtatcattgaaaacgctccatcaacattcggtggtattggatcagtatataatgcattcattccatcattaacattaggttgtggttcttacggacataactcagtatctaacaacgtaagtgctgttaacttaatcaatattaagagaatagggagacgtaataacaatatgcaatgggttaaacttcctccaaaagtatactttgaaaagaattcaattagatacttaagagatatgaaacatatggaaaaagccatgatcgttactgatagaagtatggtaaatcttggttatgttgaaaaaatcgaagacgttattagaagaagacgtaatcatgtagatatcgaattattctttgatgttgaaccagatccaagtattgatactgtaagagaaggggtagaattaatgagaaaattcgaacctgattgtatcattgctttaggtgggggatcatcaatggatgctgctaaagttatgtggttaatgtatgaaaacccagaagttaactttgatgatatcaaacaaaaattcatggatattagaaaacgtgctttcaaattccctgaattaggtaaaaaagcaaaaatgatctgtatcccaactacatcaggaactggatcagaagttactcctttcgcagttatcactgataagaaagaaaacaaaaaatatccattaactgactatgctttaacaccaactatcgctatcgttgaccctgaattcgtaatgtcattaccaggagcaatcgctgctgatacaggtatcgacgtattaactcatgcggttgaagcttatgtttcaattttagcatctgactttactgatggatgggctaaacaagctgttaaattagtatttgaatacttagaagaatcagttaagaaaggtactccaattgctagagaaaaaatgcataatgctgcaactatcgcaggtatggcattcgcaaatgcattcttaggaatgaaccactcattagctcataagattggtggggaatggcatattccacatggtagaacaaatggtatcttattaccacacgtaattagatataacggaactattccaactaaattaaatatctggccaaaaattgaaaactataaagctgatgttaaattcatggaattagctcaattaattggattaaatcctaaaactccagctgaaggtgttgaaatgttcgctgatgcttgtgaagaattatgtcacaaagtaggtgttgcatctaacgtagaatctcaaggtatctcaagagaagcttgggaagaatcagttcatagaattgctatgaatgcttacgaagatcaatgtacaccagctaaccctagaatgcctatggttaaagatatggaagatatcttacgtaaaatttacgattacaaaaataaatttgataaataatagttaaggtaggcatgtcctaccttttcttttttatattttttgtaacggaatttattcacattttattatgaacaacaaaaagaagaatttgaactatatgcacaattagcaaattatgaaacgcagttttatgagtaagaatttctcttaagagaaagttcataatgaattcatatagaattgttatattaatcatgtcagatgaagacaatataataaacaagtataagtgacccctctcccaaaaaatcacttatacgcaaaggaggaacgcgtgttcctttttttttttgtgcaaaaataattaatttattattgaaataaatatttaatattgttagaataagaaagggcaatacagtgtcttccataggaaggcactttttatttttatagatactagaggaggatagaaaatggctaaatacatatttgtaacaggtggagttgtgtctggtcttggtaaagggttaacagctgcatctttaggaagaattttaaaacaaagaggacaaaaagtcttcatgcaaaaattagatccatatattaacgttgatccaggaacaatgtcaccttatcaacatggggaagtatttgttactgcagatggggcagaaacagacttagacttaggacattatgaaagatttattgatgaacaattaaataaaaactcatcaattacaacaggtagaatttatagtaacgttatttcaaaagaaagacgtggagattatttaggagctactgtacaagttgttcctcatattacaaatgaaattaaagaaagaatttatgcagcagcacgtagttctaaagcagatatcgtcattactgaaattggtggaacaacaggagatatcgaaagtttacctttcattgaagctatccgccaagtaagattagatttaggatatgaaaatactgtttatattcatacaactttacttccatacattggagcaagtcatgaagtaaaaacaaaaccaacacaacatagtgttaaagaattaagaggtttaggtattcaaccagactttattgtttgtcgtagtgaacatcatattgaaaaagaattaaaagacaaaatttcattattctgtaatgtaccaacacaaaatgttatttctaactacgatgtagaaaatttatatgaattaccacgtatgttattagatcaaaaaatggatgatttagtattacaacatttacaaatcaatgcaccagcagcacatatggaagaatgggatgcattagttaatcgtgttaaaaacttaaatcaagaattaaatattgctttagttggaaaatatgttcaattacctgatgcttatttatcagttaatgaagctttaagacatgcaggatattatgtaaatagtgttgttaatattgattttattaattcagaagaattaaataaagaaaatgtagcagaaagattaaaagatgctgatggaattatcgttccaggtggatttggtgatcgtggtattgctggtatgattgatgctattgaatatgcacgtacaaataatgtaccacttttaggtatttgtttaggtatgcaattaattaccattgaatatgctagaaatgtttgtggtattaaagatgctaattcattagaatttgatgaattatgtaagaatccagtcatcaacttaatgtcagatcaatctttagaagatatgggtggtacacaaagattaggtgattatgaatgtcaattaaattcaggtacacatgcttatcgtctttatggaaaagaattaattaaagaaagacatcgtcatagatatgaatttaataataattataaagacgttttagttgaaaatggtttaaaagttgcaggatttaatccagaaagaaatcttgtggaaattgttgaaattgaagatcatccttactatgtaggatgtcaattccatccggaatttacttcaagaccaaaccgtgcacaaccattattccaagggttaatttcagcagcacatgatcgtaaatataataaataaaaatatttcaggaatttctaagtgaaattccttttttattttttacttgttgaaagcgcttgtatcatatataatatatgttatttaaggggaaatagtatggcaaagtataataaaaataatattttaattggaaatttgttagatattgttaataaggcatctcatgaaacaacggatgttttaatagcaaaaatatttttagaaaatagatataatcttaatgaattgtctttagatgatcttagtaatcaatattatatttcacaggcttcaattagcagatttataaagaaactaggttataaaaattataatacttttaaatatgatgtagcgagttcaaatgaaaaaatggaaagtgtacatgctattcaagatagggatcgaatcaatgatgcaatagctataaaagaagaagttatttatagaatcaatgaagcttatcaaaaaatgaatgatttaaatgtgaatgatattttacatattgtagatttgcttaataaatatcaaaatattatttttttcggttctgaattatccatggcaatgtgtaaaattttacaattaggattagttacattaggtaaaaatgtatatacaatatatgataaaaattatcaaaatgaaatgattaataaaatgagtgaaaatgatttacttatatgtatttcgattgaagatagatggtttcatatacaagagtcaataaataatttaaaggaatcaacaagttacaaaatgatgtggacattaaattcttctaaagatcatttagaaggttttgatgatatttttgtttttggaaaacaagtttttgataattatggatatcatgaattaatggtattaattatgattgtttatcgaatattaatgaatcattcaaataatgaatgattcattatttttttgattttttaattcatttataaattcatcaaaaagatttttctatgctagaattgaaagcggatacaaaaggaggaagggaatatgaaaagaaaattatccgcattgttgattgttttaacattgttgttttctaatgcaggtttagtaaatccggtatttgctgatgatattgttgaagttacacaagatcttaattctaaaatcagtcagttgcctgaaacaatgcttgctagtgaaaatgttgctaaaacatttcaacaacttttagacattcaagaaaaatataacaaattaagtgatgaagaaaaagagagtgtcacaaattatagtaaagtagaaaagctattaaatcctaatgatgattctttaaatacagaatttgtaagtcaaaaaacaagttctttaaaaggaaaaacaataggttatttaggttcttctattactgttggttttagaagtgaaaatgtcgctttccctgattatattggtaaaataacaggaagtataacagtcaaacaagccattactggtggaccacttgctaaaaaagaaggggtaagagatgaagtaagttatattactcaattggaagataacttatctaaaaatgaaaacttagatgctttagttgttcaattatctacaaatgatacaactcttggtattgaaatgggtgaagtttcatcatctcaaaataaagatgattatgattattctactgttataggagcaatggaatatattattgcttatgctaaagaaaaatggaattgtccagttatcttttatattaatccttatttaagtgatgaagttattgaaaaatttgctaaagaaaataatgcaaatatagatgaaatcaaagaagcatatcaaaatacttatgaaaaaatgattaatgcattatataaagttcaaaataaatggaatattggtgttattgatatgtggaataatgatgcttttaaaaatattgatattgatttgagaagcaattattatatggcagatatcattcatccaacaaaagcaggatatttattctggtatacaccatatattcaagctcaattagaaaaagagttagaaaataaatctactgatgaaaaagaacataccgttactttaacacaagcaagtcataatagatatgactataatgctttggaagatggttatacaacagattattcaagtattatgtcaccacaatattatgtatatgctggtaatgttaataaagaagaagctgaaactttattagatcaaatgaagatagctgataatttacatgaatgggctgcaacaattcatgtaataacacctttgaataatgatcaatatactcaaaaagatgctgattcttttattgatttgttaggtacaggatcttcaaatgttaaagtaataggtattgatgatggagctacttttgtgaataattatatttcacaagaatgttatgctgttgctgatatcatgacatatggtggaacaatggatgaaggtcatgattataatgtgccagttccagcatatttaagtcagccttgtcaagaagctgttaattattatgtaaaagctaatcaagctgaaaagggaaaagataatgtttatcttaataaagaaaatgaattacaaagagtagttgttggttataatgaaagtttagctgaagcttttgaaaatgcatgggaagaagttttctctaaaaattatagacaacataatgaaaaaactgaattttatatggcaagtgctaaacaatacacagatccatatttattaattaatattccaaattttaaagaattaaaaattaattataatccacattataatgaaagtttaaatggtgaaggtcaatatacttggtttgagtatattccacaaagtactttaaaaatggaaaatggaagtgttccattagttgtatcacttcatggtaatggaaatgatgcaagattacaaggtgaaacaactggttggccagaattagcggctaaagaaaactttatggttgtagcgcctgaatggcaagatgtcgttcttgattcttctactcatgaaccaggtcctaacttttttaattgtgatggtttagaaggagataaattaattgaatggatagaaatgttagaacaaaaatatccacaaattgatgcttctagaatttatgtaacaggattatctgcaggaggtagtgcttctacattatatggtgcaaaatatagtaaagtatttgctggtgtaggtgctgtttctgcaccaggtgttgataaagatgaattaacagaacttgttaaaacttataatggtggagaagttccatatctttatttatgcggagatcatgatttctttggaatgattcctgttgatttatcaagcaagaatgcttttgaagtagcacctggagtttatcttcctagtgtagatagcaatgttgatatgttcccatttattcaagcatatcaaaaaatcaatcatctcactgtttcagaaaaatatgatatgtctttaaatgaatattatggtattcgtttagataatgaacaatggatcaaattgggtgtaaaagatacattagaaggtactttatcaaatgaaaatggtgttataatgaaatttgctgctattaaagatcaagcacattggaattataaacctgaagcacaatatatgtggaatttctttaaaaaatatcaaagagatacacaaacaggtgaattgattcgtgttgataaaaataataatgataaaaatgatgataaaacaaatacatcaactaaaaaacctgaaaatgtaaaaactggggatgaaaataatattttattatttggatgtcttgcattaattacaggtggagttattgtttatattaagaaaaaagaaatgaattaaaaagaaaaaagattgttaaagaaaaatagttcttaacaatctttttaattatgtaaaaaaggagattgtcgaggcaatctccaaatttttatttcttaggtaatttaaatgagctctttaatgaaacgactctattaaatacaaaatgatcatctgtagaatctttggtatcaatacagaaatatccatttcttacaaattggaatgaatcaccaggtttatatttttcaatagctggttcaacataacaatcttcaataacagttaatgaattaggatttaaatttaaagatccatcttcattataaacacctttttcttcatcaactaagttttcatataaacgtgctgttactttcttacaatgatgaacaggaacccaatgaattgtaccttttacttttctaccagtaaatcctgtaccgtttttagtaataggatcataagtacaatgaacaacagttacttttccattttcatctttttcaaaatcaacacatttaacgaaataagcattcattaaacgaacttcatttcctgggaacaatctaaaatattttttaggtggttcttccataaagtcatcacgatcaatccataattctctttcaaatggtactttttcataacctaaatcaggattttccatgttgaccatcgcatctaaatattcaacttgtccttcgggatagttatcaattactaatttaataggatctaaaacagccatcacacgaggtgctttaggttttaaatcattacgaatacaatattctaacatcgcataatcatttgatgagttactttttgtaacaccgactaattccataaaagatttaattgattcaggtgtaaatcctctacgtcttaaagcagcgattgtgactagtcgaggatcatcccaaccatcaacaataccttcatctactaaacgtttaatataacgttttcctgtaataacgtttgttagataaagttttgcaaattcaatttgttttggtggatgttcataaccaatttcttgaacgacccaatcatataaaggacgatgatcttcaaattcaagagtacaaattgaatgagtaattccttcaatggcatcttcaattggatgcgcaaagtcatacattggataaatacaccatttatctcctgtattatggtgtgtcattctggcaacacgataaataataggatcacgcatattgatatttgatgaagccatatcaattttagctcttaatacttttgatccatcttcaaattcaccatttttcattctttcgaataaatctaaattttcttcgattgaacgattacgatatggagaatctttaccaggttctgttaaagtaccacggtattctctaatttgttcaggacttaaatcacaaacataagcttttccttttttgattaaaagaacagcagcttcatacatttgatcaaaatagtttgaagcaaatttgatatcaccatcatatttagcacctaaccattctacatctgaaacaatactttcgacgaattctgttttttctttcattggatttgtatcatcgaaacgtaaattgaatgttccattatattttttagctaatccataatttaataagattgatttagcatgaccaatgtgtaaataaccatttggttcaggaggaaaacgtgtcgcaatttttgtatattttccttccgctaaatcttgatctataattttttcaataaaatttttacttactacttcttctttatccataggaagtcctcccataatttttatatgttttagtttaccatattttccttgattataaaacatccaatacttcataaattagaaaatatgtgctagaatgtttgcggaaggtgataacatgtttagaataggacaatcgattgatattcatcaattagtagaaggaagagatttatatattggtggtgtaaaaattgaccatgataaaggtttattaggacatagcgatgcagatgttttattacatgccattattgaaagtattattggggcattaggtcttggtgatattggaaaacattttccagatacggatcctcaatataaaggaatttcttcaatggttttattggaacattgttatcaactgatggataaagaaggttatgaaatcaataaccttgatagtattattatgtgtgaagcacctaagatggctccacatattcaaaaaatgagagaaaatgtcgcaagtaaattacattgtgacatcagccaaattaacattaaagcaacacgtggagaaaaacttggttttgtcggcagacaagaaggaatggtagctcaagcggttgtattattaaggaaaaaaggagtatagaaatggcaaaagtaagaacaagatttgcacctagtccaactggatatatgcatatcggtaacttaagaacagcattatatgaatatttaattgctaaacatgatcatggagattttattttaagaattgaagatactgatcaagaaagagaagttgaaggtgctgttgatatgatctataaagttatggatcaaacaggattaggttatgacgaaggacctaataaaccaggagaagttggaccttatgttcaatctgaaagattagctatttataaagaatatgctgataaattagttgaattagggggagcacattattgtttctgtgatgaagaaacaatcaataaagcaaaagaagaatctgataatgaagaattaggatatattgatccttgtaaacatctttctttagaagaagcaaaacaaagaatcgctaatggtgaaaaatatgttgttagacaaacaattccaagtactggaattacttcttttgaagatgaagtttatggacatattgaagtagaaaatgcgggacttgctgaaggtgttttattaaaaagtgatggttatcctacatataactttgcgaatatcgtagatgatcatttaatgaacatcacacatgttgtaagaggaaatgaatatttatcttcaacacctaaatataatttaatttatcaagcatttggatgggatgtaccatcatatattcattgtccacctgttatgaaagatgaaaaacataaattatcaaaacgtaatggggatgcatcttatcaagatttaattaataaaggtttcttaaatgaagcaatcttaaattatattgctttacttggatggtcacctgaaggtgaacaagaaatcttctcattagatgaattaattgaagcgtttgatgttaaacgtatttctaaatctggggctatttttgatatgaataaattaaaatggatcaatagccaatatattaaaaaattagatacaaaacaattaacagaattatgtttaccattcttaaaagaagcttatgatttaagcaataaaagtgaagcatggattgaaaaattagtagaagtgcatagagatcatatttcttgtggtgaagaaatcgttgaacaagttaaattattctttgaagatgaaattcatttagaagaagaagctattgaatttatgaaagatgaagctattccaaatactttagctgtatttaaatctaaagtcgcagaattagctgaagaagattttaaacaagatcaaatttttgcttgtattaaagcgacacaaaaagaagcaaaagcaagaggaaaaatgttatacatgcctttacgtattgcgacaactggtattatgcatggtcctgatttagcagcttctatggaattattaggtaaagaaaaagtattaaaaagattaggataggaaattattcttatcctttttttatgttttttttacatagagtttgatttatgttgctttttttgaaatgaaggcataatatattgtcaaaagtacggtacttttcacaaaaaagacataatgagatggtataataggttagaaagaggtgataacaatgaagaagaaaataattggtattgttttaacattctttgttgttgtaagtactcttcttacgatttttgcttttagaataacacccgttactttaaaaagagatacttttgtttatgaatatggaacaccaatttctaataatccggcagattatgtcaatgctaatgcaaatgttattaatgaggtacaattaaatttttctaatttaaaaaatgagataggtgtttataaagtatcggcttcttatgcgggagtagaatttccattttacattaaaattcaagatacaacaaaaccagttgtaactttaaaacaagttgtttttaatgtgaatttaaatgaagaaattagtgctttgaatttgatcgataaagtagatgatcaatcagaagttattgcttattttttagaggatgatggaacaaaaaatacaactcttaaattcacaaaaaaaggttcttatatagttaatattcttgtagaagatgtagtgggaaatcaagcggctaaattaagagctaagattgttgtgggaagcttaggaaatcatccaacgcttgaaggtattgatgatgttgaaattgttcaaggaacacattttggtattatggaaggtgttaaagctagtgatggtaatggaaatgatattacacatcaaattaagattttgaaaaatacagtcaatactgaagaagtaggaacctatgaagttatttactcaattacaaatagtcagggtaataatattcaaagaacaagaaaagtagaagtgattaaaaatgaaagtgagaagaaaaaatgagtgtaactttagcgatgattgtgatatccgtagccatttatgttattattaattttatagatcattcagatgaaaaatcagtgttagctattaaatatggagctttttatcctcctaaaatagaatataaacaagagtattggcgctttttaacagctaattttgttcatgttgatttagttcatatttttatgaattgttatgcactttattatttgggtggaactttctttgaaccttttttgggaagtttagaatatttgtatctagtattaatttctggaattttttcttatcttattacttatatgacatctaaaaaagagggacgttatcaaaatacgattcctttaggtgcaagcggtattttttatgggtttttgggagctattgtgactttaggtgttgtttttcaaggaccatttttaatggttttaaaacaatttattcctgtcattgctattaatgttgtttttacgttggcagataaaaatatttctaaaacagggcatttaggtggctttattggtggtgttattgctatgctagtgcttattggaagtggcttatgcgtttattaattgatggagatgcttgtccagatcgtcaaaaagttattgaacttgctttacattatggagtagaagttttattgtttattgattttgcacatgttattgaagatgaaagaattcaaataattatgtgtgaagtaggaaaagatagtgttgatcaaatgattctttcttatttacaagaaggtgatctattgattagtcaagattatggacttgcaagtttagctttgcttaaaaatgtaacgatacttcatgtatcggggaaaagaattacagaagataatattaataatttgttgacttctcgttatttaggacatctttctagaaaacaacataagcatgtaaaaggacctaaaaaaaggaattataggacatcacaattctttttaagagaattagaaaagatatttattgaaaataaaataaacgaagaaaaagcaatactagaataaacatctagcattgctttatttttattttccagaatctccgtagtttttaagcacacgagcacttggatcatcaacatcacagttttcccattctttatttggcatccagaaatctttgatccattttccttgttgtgggaagaatgattcaaaaatatctctatacattaatgattctttggtgaaaggtgtacaatatgaatatttatctttagcatttaaaacatcttcatcactgtatttatcttcagctaattcttttaaataatctaccattgaatgaccaacagcatcagaaaaagctgctttttctctaaataaaatatcgtgtggtaaataatcagttccttcaaaagcatgtcttaacaaatattttcctttattataaacattcatttttttagcaggatcaatagacatagaataatcaacaaaatcaagatcagcaaaaggaacacgtccttcaagagcatgtgcagaaatacaacgatcggctcttaaggcatcatacatataaagttctttgattcttttacttgcttcttcttggaaagctttagcgttaggtgcaaaatcagtatatttataaccaaataattcatctgaaacttcaccagtcataataactttaatatcggtattttggtgaatatatttacataaaatatacatggccatactcgcacgaattgttgtaatatcgaaagtttcgagatgatagatgacttcttttagatgttgatagagatcttctttattcataataacttctgtatgttctgttcctaaataatcagcaacttgtttagcatattttaaatcaataggatcactttccataccgatagcgaaagtacgaataggtttatctgataatttttgaccaatggcgcatactaaagaagaatctaatccaccgcttaataaatatccaattggaacatcagacataaatcttttttctacggctttttcaagttttgtttttaattttccagcaattgtttctaaatcatcatcaacgattgttttaggatcacttaaatcattataacaaacaaattgaccatctaaataataatgtcctggtggaaaaggcataatatcatcacataaatcaaataaagctttggcttcggaagcaaaacatatttgatgttcttttttactataaccataaaacataggtctaattcccattgggtctcttgctgccattaactgttttgttttgttatcgtataaaacaagagcaaattcagcatctaaatatttacataaaatttcaagtccatattgttcatataatggaatcaaaacttcacaatcactaccagatttaaaagtatagctactttctaattttgtttttaatgctggatagttatatatttcaccattacatacaagtgtataatctttataaacaaaaggttgatttccatttgttgataaatccataattgataaacggttaaatccccatgttattccatgatcaattgagacatgttgataatcaggcccacgatacgctgctttatctaaagctttttggaaaacctgtaattcaaattcttcacttccaacgactaaaaaaccacacattttaatatcccccttataattaaaaaacgcacatagtgtgcgagtatcgtgtaacatataaatccaaagatatacatggtacggaaaatacttcaaagagtactcgatacccgctagttgtaacataactagagacgttctagcctacttgcattgctttcggtagacagctcgaaggtgttcttcatattttcgttcactgctagtctttcaccttctactagctcgctgttgcttcgtaaaaatactactctccttgtctttgcttttaacttgtttacagtatagtataggatttataaaaaatcaataagaattaattaatatgataaaaaatatttaattttatacaattataaaatgtgaataacttttgagacaaatttgagacaaaaaacataaaaaaatcatgtataatgttaatgtctagaaaaatataaataaaggagtttaaaaatgccaaaagatatacacatgttagtaagtatgattaatatgaaattaagagacgatgatatgcaattatcacatgttctttctgtttatgatttggatgaaactgagtttatgaaaagattagatgaaaacgaatatttttatgatgaaagtacaaatcaaattaaaacaaaataattgttttatcgaagaatagtgatataattatgaatacttaaacggagggaatttaaatgttaaaattagaagattttaaagcggctaaaaaaagagttgatgaagttatcttaccaactcatttaatacatagtgatgccttttctgaagaatgtggaaatgatgtctacatcaaacctgaaaacttacaaaaaacaggagctttcaaaattagaggggcttacaataaaattatgaaattagatgatgaagcaaagaaaaaagggttaattgcttcttcagctggaaatcatgcacaaggtgttgcttatgcagcaaaaaaattaggggtcaaagcaacaatttgtatgccagcacatacaccattaattaaagttgatgctacaaaagcacatggagcggatgttgtattatatggtgaagcttatgatgaagcttatgaaaaagctgtagaattacaaaaaagtgaaggatacacttttgttcatccttttgatgatgaagatgttatggaagggcaaggaacaattgctttagaaattatggaagaacttccagatgttgattatattttagtaccaattggtggtggtggattaatttcaggtattgcttgtgcagcaaagcaaatcaatccatctgttaaaatcgttggtgttgaaccagaaggtgcagcgagtgcccttgccgcagttgaagatgatcaacttgttaaattaagtgaagtaagtacaatcgctgatggtacagcagttaaacaaattggagaaactccatttgaatatattaaaaaatatgttgatgaaatcgtaactgtaagtgattatgaattgatggaagccttcttattacttgttgaaaaacataaattaattgctgaaggatcaggtattttatcattagcagctttaaagaaattacattgtaaacgtaaaaaagttgtttcacttatttcaggtggaaatatggatgttatgacaatttcttcgatgatcaataagggacttatttcaagaggaagaattttaacattctctgtacaattacaagatattccaggacaattagaagttgtttctcatttacttaatgaatgtaatgcaaatgttattggagttgaacataaccaatttaaaaactttgctcgtttctctgaagtagaattaagagtgacttgtgaaacaaatggtgaagctcatattcaagcgattgctgataaatttaaagaaaatggttatattattcaaaaaattaactaatcttataaaccgcttaggcggttttttattttcaatgaggtgaagatcatgatttataaatattttaaagagtgtaaaaaattaattgtattgattactttattaggcatgcttattggtatgcttttttttataactaaagatacaccaccaacactggtactaaaaaagaaaaaaatcaatattgaatatggacaaacttattatgctaattttaaaggcttagtggatacaacaggaatgagtaaagaggagatttgttatttaaaagagaatgtaagtataacggataatcttcaaaatgaagatcaaaaaagttatccagcagtaggaaaatataagatttttataaaatataataataagctttcaacgattcaaattatttgtaaagatacattagcacctgtactggcatttcctaaaaatgtagatgttataaaagaaagtgatttagaaagtattgattttaaatcattgatcatagctaccgatttatcaccattaaaagaaattcaaatagatacaagtcaaatcgatattcatagaataggtgaatatcaagtaaaagtatttgtagaagatatttataaaaatagaagagaaaaagaatttaaggtcaatgttatagaaaataaacaagaaacaactaattctcaaaataatcaagaaaataatgtgaataagattgaaagtgaaaataataaaccgaatgaggacattacaatctctcaatcaaatgaaaaaaataatgtaaaggatcatttagataatgatcatcaacaaacaaagccccaacaaacggtttattggtatgaatgttatctttgtggattatatgttgattcaaatgtttctttagaagatgctaaaaagaagtttgatcaaacaaagtgtacagatgctattgaattttcaggaatagagtggagacatagtagatttcattatggaattaatcattcttagaaaattgaaggaggagtaaaagtgaattgtgtttataagtggattttaggtccgtaggcaatcagagattgtctttttttattagaaattatttatgatggaggaatatgaaatgaaacagaaaaaaatatttgataaagttatgaaaatatttgcagttatggtgtttattttgtctatgtgtttttcacaaaaatatgcaaataatgtcgaagcatgggataatagtacacctcatgaatttacacgtattaaacaaattgattatccatggtggtggtcttctaaaataagtagtgcgaaaaaatggtccacttatatgtgtaagtatgataataaatatgcttattgtttagaagcaagtaaaaaatcaccatcagctggaaaatacccagctcaagtgattgaaaataatgaagctgtaagaaaaattctttattatggatttggaggaccaggctatgatcaagcaattaaagaaatgtatacagttgaattaaattcttgtgttcctgatgattttggagaaaagcatggtaactttgatgatggtgcttatttgtttacccatatttggctttcttatgcttatggcggagatttaatggggttaaacttaaaagatttcaatgctaaatggccaaatgcagatggtaatagtggttatggagataatattttatggggctataactggcttatgaatcaacctgatattggttatgcttattttagcccaagtcaagatggtggagttacagcctcttttaaggctgaatttgataaggtaaataaacttcaaaaaacaaatactgttaaattagaaggaacaagtcattctaccattcaagttcctttacaaaataatgttacactatataacgtaacaaaaggaacgatgcaaacagggggaacggtaactgtaaatggtggagaaagtttctatttaacagcaccatgcaaaaatagtccagaaaattataagtcaggaaatattgcgggaaaaggttgtgaaatgtttactgcattagctattaaagatggtgcagaagggacacaaacagaaggttcatggaatttagatcctgatggaaataaattaaaatatgaagttgaatggttggattttggagcgttacgcctttctaaggtagataatacttctgaatttcaaaaaaattctaaatttagattaatttcaacttcttatacaggatatgatgaaacttttgaagtcacaaaagatgaaaatggagattatgaattatttattgattatttacctgtaggaacttattcacttactgagattgaatgtgaagatcactttgcacctgttgttgctaaatggcaagtgacaattgtaaaagataagacaacaaagaaaattgttgtaaatacattaagaccaacaggaacattaaaacttcaaaagaaacttgaagatgcatgtcaaggagctgttgatcttgcagataaagatattaaaaaaacaaaatataaagttgtagcaatgaatgatattgttgatacagtatctttgaaaaaattatattctaaaggggaaataattactttaggaagtggaaaatgtattgttgatacaaatgatggtcaaatgattacttattcaaatggtgtacaagtttcaaaagggataatgaatgaagaaggaattatttctgtagatgaaaatggtcaattagaaatgacaggaattcctcttggaaaatatcaagttgttgaagtttcatgccctcaaggttatgttttagattctacaccttatgattttgaaattaaacaaaaagatcatacaacaacaatttatacaaactatcatgaacaaacaaatcaaattactaagacaacatttactaaaaccgatgttactggtgatcaagaagttagtagtgctaaaatgtctattacggatttagagggaaaagttattgatgaatggatttcatctaataaggcccatgaaatagatggattagaaagtggaaaaacttattatttaaatgaggatacaagtccagcaggatatgtaaaagcaacgaaaattgaatttaaagtcaatgaagatggaaaaattcaaaaagtaaatatgaaagataaagttgtaacaatttctaaagtaactttaggtggtgaagaaattcaaggagctttattacaagtaatagatgaggaaggaaatacagttgatcaatggtatagtgatggaaatgaacatcctgtaagtgggttagaagaaggaaaaacgtatactttacatgaagatttagcacctttaggatttaatttagtaaatgatatatcttttacagtttcttatgaaaaagaaaatcaaaaaatagaaatgattgatacttttgttaaagtttataaacaaaaagaagatggcaatttgttaaaaggggcacagcttacagttgtttctacaaaaacaaaaaatagaattgatcaatggattacaggacaacatatttttgatattaatgatgttatgaagaaaaaattgttaaaaggggatatgtgtcaaggtaaaaatgaagaaggtattgaatataaagttgttccccaattaaaatcaaatgattattttttaatgttgaaagatggagaagatgtgacatattattgtatagatattcaaggagatgagacagcccacttaatacaaggacttaatagtggggaaaaatatattttaagagaaacattgacaccttgtggatatgcaacagctaaagaacaaatttttgaaataagagaaaagaatattgttttaaaagttgttgatgaagatattaaagtggatatttctaaaaaagacataacaaataaaaaagaattgtctggagctcatttacaagtgaaaaatgaagatggaaaaattcttgattcttggatttcaactgatcaagaacaccgcatttgtcatttgaaagttggtgaaaaatatattttagaagaaacaatggcaccttatggttatgaaaagagtgaaaaagtcgaatttgtgattaaagatactggagaaatacaaaaagtcatcatgtatgatcaaccaattattcaagcaattaaaacaggtgatagttcaaagttgaattattttataatgcttggtgctttaagtggaatttgtatttttttatgtagaaaaagggatgttaaatcccctaaatctaaatgatttcatcaataagaccatattctaaagcttctaatggatctaagtagtaatcacgatcacaatcatgaatgattttttctaatgattgtttagaattttcacttaaaataagtgaaagttttttcttttgtttgcatattcttttagcgtttatttcaatatcacttgcttgtccttctaaagaggcaagaggttgatgtatcattatttcactattttttaatgcacatctttttcctttggaacctgcacttaaaagaatagaagccatacttgctgccatgccgcaacaaattgtgctgacatcacatgaaacaaagttcattgtatcaaaaattgctagtcctgcagaaacactaccgccaggtgaattgatatacatgtaaatatcatttttattatcttgtgcttctaaataaagtaattgaccaataattgaacttgccatggcatcgtcgatagtccctgtaagtagaataattctttcttctaaaagtttggaatagatatcgtaggcatattgatgatttttatctttttctataacggttggtattagatgcataaaataacctccatatgtaattatagaaattaataataaaaattattctttgcactgatgaaataagtaaaaatttttttaaaaaaatagtagaaaatagtgtaagcgctaacgatataatgaaatgggaattattagaaaaataaaggaaaaattaatgcatcttatacaagaaatcaacgttgtaatagttgcttttgtgaagtttttgacttataataatggcataaaagctatttacaaggaggaatattaataaaatggcagtaaaagtagcaattaacggatttggacgtatcggacgtctagcattcagacaaatgtttaatgcagaaggatatgaagttgtagcaatcaacgatttaactaatcctaaaatgttagcacacttattaaaatatgattcagcacaaggtaaatatgcattagctgatacagtagaagctggtgaagattcaatcacagttgatggaaaagaaatcaaaatctacgctaaagctaacgcagctgaattaccatggggagaaatcggtgtagacgtagtattagaatgtactggattctatgtatctaaagctaaatctcaagctcatatcgatgctggagctaaaaaagttgttatctcagcacctgctggaaatgacttaccaacaatcgtattcggtgtaaacgaaggtactttaaaagcttctgacactatcatctcagcagcttcatgtacaactaactgtttagcaccaatggctaacgctttaaataatttagcaccaatcaaatctggtatcatgttaacagtacatgcttacactggagatcaaatggtattagatggacctcatagaaaaggtgacttaagaagagctcgtgcagctgcagttaacatcgttcctaactcaacaggtgctgcaaaagcaatcggattagtaatcccagaattaaatggtaaattaattggttctgcacaacgtgtaccagttccaactggatctacaactatcttaacttcagttgttgaaggtgaagttacagttgaagaagtaaatgcagctatgaaagcagcaactactccatcattcggatatactgaagaaccattagtatcttctgatatcgtaggaatcacttacggatcattattcgatgcaactcaaactatggttaaaccattagacaacggaactactgaagttcaaacagttgcttggtatgacaacgaaaactcatatacttctaacatggttagaactattaaatattttgctgaattagcttaatctagcgaaaaatatgctaaataaaaaagggtttcaagatagaaagccctttaaagagggcttttatatattaatcacaaatcacttatcacaaatcacttatcacaaatcacaagtgatttgtgattgttgatgataaaataagaataagaagaaatagaaagaagtgagtgattgtgggaaatttaggcgcacaaaaagaaaaacgaaatgatacaccaatcagtgcaaaaaaagatataatgggagataagacggttcgtgttcgtgctgacttgcaccatatcataaaaatcgaaacagcaaagaatggcggaaacgtaaaagaagttatggaaataagacttagaagcaaacttaagagtgtgttgatattgcagtatcttaaaattttgtgtataataggaattgaagttaaattagatgctaaaaatttgtaattaagaaggagggattcgtcatgttggtattccaaatgcgtaatgtagataaaacatctactattttgaaacagactaaaaacagtgattacgcagataaataaatacgttagattaattcctaccagtgactaatcttatgactttttaaacagataactaaaattacaaacaaatcgtttaacttctgtatttatttacagatgtaatcacttcaggagtgattacatgaacaaaaatataaaatattctcaaaactttttaacgagtgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaatactcgtgtcactttaattcaccaagatattctacagtttcaattccctaacaaacagaggtataaaattgttgggagtattccttaccatttaagcacacaaattattaaaaaagtggtttttgaaagccatgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaaataattctatgagtcgcttttttaaatttggaaagttacacgttactaaagggaatggagataaattattagatatactactgacagcttccaagaagctaaagaggtccctagcgcctacggggaatttgtatcgataaggggtacaaattcccactaagcgctcgggaccccttgtaggaaaatgtcctaagtgtggcaacaatattgtattaaaaaaatcgttttatggttgttcaaattatcctgaatgtaagtttactagccctttaaagagggcttttatatattaatcacaaatcacttatcacaaatcacaagtgattaatcacaaatcacttgtgatttgtgattcttaatgatacaatattactatacaaaaaaagaatggggcgtagttatggagaaggaaaaactaaaaatacttgaagaattaagacgtatttttatctaaataacgagctgttataacccatgtaatttgtccgatagcaataactcctgctatcgaaaaaaatacaactttactcatatatcccataaagacaagagcaaataatacaagaaccaataatgtaagtgttactttataagcattcgcaagagaagcattagtaattgcgatatttctttcatcattttctaatatttgcatttcttttgttggcttactgaatatatcacaacccataaaaatcaatattattccaataagcgttgtaccatagacaaccaaatctggacgaggtacgggcaatagttggtgtacgcctaaaccataagttagtaaaccacctaaaaagattattacaccgataaataattcaactttttgtatcttatgtttcatttgctttcctcctcataaataaatatttcttcaatactcatttgaaagtaccttgcaattttaaaagctaagataatagagggattgtagcgtccattttctaaagagcctattgtttgacgagatacttcaagagcagtcgctaaatcttcttgtttaatacctctttgttttcgtaattcttctaaacgatttttcacaacatacccctttcttgaacaaatggaaagtttgctttccttttctaatcttatgatactcctgcaagtaaagaatgtcaagcaaactttccatattttattatcctacaatcttccagttgctatccttatgtagcacaagttcatactgcgatatttgtgtagcctttgtctgattatcaaggaatttcacagcaactttgactttcacattgtccccgtcctttgtaaagatagggtttaccagttcagcataaatgtagtccctgccgataggctcaagcacatttcccgatacatagtaggcaagctctttttctgtggctgtcgggtacagcttaaagaatgtttcaagaaatgcagtagcgtcattgacggtatcagcgtctacacttgcatttgcttctggtgtcttaggctcataatctgatttctcgattgctggtgcaagggtagggttctgaacgattaccatatccccgtcagcgtctacatggacttttacggtataggttgctttcacattgcttgtctgttctccctcttttatctgctgattcacttcgtaggtagcagaaaaagtgtccgttcccgactgttcaatactccatacaatcacatctgtaactgtggagctggtcggtatatcggttctaatggtatccacattcaagtcctgcaattcctttgtcagataaccgctgattgcctgcgtccttgcttcaatcgcttctttgctgttactccatgtgtagtagggctttgcaaagttcttcacaaaattttctatcccgttggtgtcctgcaagcgaagctctatgatttctttttcatgggtcgtgtgctggtcgatagccgtaaaattcttatacgccccaaagctcacgcttgcgataagcaccacccacaatgcaatcacggattttttatgtgtgcctaccttgaaagtacgcacctttttttctttgggttatttgatagtttctgtctgtttcttattctttctaaacatgatgaaatcctcactttctattgttttactcgtcctgcaccgattaagtgctgttgccagtaactactacttaggtctgcatatcctatcgggtcgcctgcgtggtacatctgtgtcggcgaaacaagaataccgacgtgtgttacataacttccagcgttataggtagaatggaaaaataccaagtccccagcctttgcctgcgaaagtggaagatgttgggttgcgtcatactgtgcttgtgcggttctcggtaaggagataccagcttttccatagcaccattgcgtcagtcccgaacagtcaaaagaagtgttgggattgctaccgccatacacatatttccagccttgatattttaacgcttcattcatgaccttttgtgccagctctcccgatacctgcggaacagttaaatactgattgactaattcgacgtaaaattgattgccatactgataccgccaacccccgttcttcgcaacggctatcgggttggtgtaggttactttctttccacccgatttctcacgggcgaagctctctgcaaggttaaaggtgtgtttctttccttttcctgccacatatcccacataaccaccgccatagttataggactgtatcgctacattcaaatcgtcgataccttgatttttacaggaagaaagcagggacgcaaaatacttacacccctgcttgattgagctttccgtatctaaagagttgggcggtaaaccaagactttctgaactctgcataacatcttctgccgtaccgccactttctacttgaatgatagccagtagcacgttgacatactcggagataccgttttctctggcgtatttttccaccataggctgatgtttcaagacttctgcggataaattcatacccgtaatgccagaagaaaagttgctgttctcgtcgtcgctgtccgcactaatgaggacaccaaagaaaaggactatggaaaagaggataggaaacagactgccaataagagcgatatgtttcagtttcattttttcttctgtcctttcttcgttacaaggttacggttcttttcggtatgttccgttgtacgctttgattgttcaaaggtctgtttctttgtagtacgctctgctttgtaattctggcgtgtttcctgcgatactactttttctacattctgcctatgtactggctgtgcaggctgggtcgctttcttatcagaagcaccagaagataacggacgctctttcacaacatttgtcttgactggttcacttgcttttgaagtggtcgctgtggcaggacgtttcacttcctgcattttttccgcactcggctttggaatggttgaagctgtggctggtcgctcatggggacgggtagctcccgttgtcgctgatccgtccgtctttctttgtcttgcttcttgtgccttttgaagctccatacgtttgtcagcgatattctgtctatgctgttcctgcttttccaagcgtcccgtctgtctggactgctgttcctgcaccatgccacgcttgaagtctgatacgctggactttgccttttcctttgcggaatacaccgcataagcggtctgtgtcggcatatccttgatattctctttgacagcgttagccttgtctttcactttatttttcgtatctaagacagcacccacctttgagcctgcacgctgtcccatgctggaagtggtattgccccgattttctttagaagccgtattttttctttcggctctcttgccagcaacggcacttccagctaccgcaccagccacaccacccgaaataccgccagcacttaccgcccttgcaatacggtgttccatacgcctagccctatgtcgcataaacagatacggtctgcggaaaattcttcgtcccatgttttgactgtcgccagcattaagtgagaacatactcattaagtcgcccagtttcatatagataccagcaaaacacactatctgcaagaacgccaccataaagaacgggtagtctgtggagatgttataaaacatactggaaatgctgaacgccaccgttacaatgagcgttattcctgcccgtgtcattatggtattaaataccctcacgattgcctgctttgccatgctttcatagctcggtatcatggaaagtagaaagctgataggtaaaaacattgcaaagataataaagagtatctggctgaacaacatcatacccgtaagcaagaatacaaatatcgtgatacctaagttaaagaatagcaggaagaacaccatgcctaaacggtttacgacctgcggtatcgtcagattgttgttgtcattgtcctcgatttctgttttcacgacttcctctctggtcttgccgtcctcgtcctctggacttactgataccagagcttctacacggtctgtcccgatttcctctgcgttgctgttaccaaattgaagcaagagccacggctgttccacttgaatggaaaacaagctgtcccgtatcaagtccacgctgtccttgccctcgctgtcagagttggggagcatgatttttgttcccaagtccaaagaagcggtactgatgtctgatgaaaattcatttatcttcttgatgtaatcgggagcgtaggcaataaaggaagcggacaacacgaacaccaccacaaagttaataacagcgtgaagtgccttgctggtttcgcgtttgataagtcccgtataggcaacataaagtcccactattaagataatgagaagcaggaaaccgacatagaagcccgtagaagaaaagccgttctcggtaacgcctgcaagggtctgtatgctctttccgatactgtctgccatatcgttgatgaagtctaatttataggcttcctgcaccacatagcccgtggcattgcttaaataaaggcttatcgtccaaacaaagttggtaatgcagtaaagcccgtactgcaccgattttccgataccgtccagccagttccatggcaaccacgaccagctattatccacataaaaatcaagctggtaattcgacagcggatattttgagtaaagattttctgcgtttatggtatcgtccacaagccccgtcgcatgagccaccgtccccagaagtgagagcaggataagggagagtgccacgacaaacagagccattttgagaaagtgaagtatcttcctttttgtgaacgcaccttttatcctttctttcatcactccacctcatttctctgtacgggcggtctggtatcaaaggcgtgtagcagttcttcaaagactgggtgtatctgcaccacaccgacacgcccgtataagtcctgcaataagcattgtccgttctccaaatcacgcaagcgtttctggttgttctcgtcgtccttgtcgataccgaaaaattctaaggtctgctttatctcgttgatgtcagtagaacgaaaggcaaacttcaagccgatattgtttttcagactttcctttgacacgtcgccagaagattgtgtaacaaaatagacgcctgcctgcatagctcgtccagcacgcaccagcttatttgataaagtttcgccttgtgccacatttaagaacgcccacgcttcgtcaaggtctacaatcttaaaaatgcttctgtctgaatggataaaatcaagggcaaaggtactaatcacaatcagcatagacaccgacaataattcaatggtcgtgtattcctcaaatgttgtatccttatctggtaatactaagtccgctacttgaatgatattgagttggttatccagactgattgcattttccaccgtaccgtctgaaaacagcaggtgtgcaaagtcgtagtccgtgaagctgtcgatatgttctgcgatatttcttgatatgggtgtatcttcacggcgtagctcgtctatcacatggagcaagccccgactgtcgctctgggtaacggagcgtaccgccttacgaagtacagggaatttttcgccgtccctagaggaaatacccgtaaggaatgttaagatgtcgattgccagactttcagcgtcttttacattcttcataatcacgaacgggtcaagaagtcctgcattgtccttgtcgctggtaaggtttacgatattgatttcatgggcgatttctgggagcgtttctttccagttgcccctctcagctttggggtctaaaatgactgcttgaccgccaaacagcaccgcataatataccagaagattgttgcagaatgactttccaccgccaagcgaaccgacaaaagcagaagcaagagcgtttgttactgtaccttttacaccctgcgaagctaacgacggttgcaggtacacatttcttcccgtatcaacggaatagcccatatagatacccgtagtttcccctaactgctgggtcgcaccaaaaccaagacctgccaagaaatctgattttacatactgcacgtagtcattgatatatcgcttgctggcaggaagaaattcagaatgaagccccagcatatccccagcaggacgcaccagctttacattgaggtcgtcgtaaaaatctttgacttcatcacaacggcgttttaattcgtccaaatcatcagccgatacacgcactacataagagagcttatacatactttcttttgtctggtctaagtccgtttccagctcatccacgctgtctaatgcgtccaccacatttgagcttgtttcacttcctgcttgataagcgtgattgtcaaggtctttcaattcctttttcttgttgcggacggttgttaatgctttacggttctccacgatttctacattcatagaagtatcaacggggaatgtgaattgctgttgctggaaatagaagatttcagacgacggaaaatcaagctcgccaacaatcgcattgacggtaaagtaggacacatagctttccctgtcctcatgttccaatcgcaaataccgctggctttcctcaatcacacaccttgtcggacggataaggtcgtagtattttatcagcgtttctttctgtaatttcttctttggtagctggtactcataatcttcataggcgataccgtccctgccgtaaagatgttccatgagatacccaaaatcatggatttccaagcgacgcaccttaaagcgacgggagattttattttccagcaacttttccattttcatataacggttgatttcatcattcggcatggaaacaaagtcattcatcagcgtgtggttcacttcatggagaaattccttgaatgtcagccacgccgattttttgatgttcttcagattgagctgttcttccgtaaccatgagcttaaagccaagaaaaaagcggtagtccacttgattgtccccaatcattgatactaacgcttcggtctgttcgtctatcttctggcaggcaacttcctttaatttccccgtaaccagcttctttgactgctcctgcatacttcgtattgagctttccgttgcaatctgcaacgcatgaatttttccctcacgggactgtgcgataagctgtcggaaactgtcatgcacgataaatttctgctctgcggataggaaagaatagttgtatggtatcagctcataataagcaaacacctcattgtccttattccagacaaggttattgtcaatatattttatcgggaacatagttcacactccttactgccgtgattgtttcattgagtatctgcttatgcagttttacggcttttcctgcataagtgattttcggtcgcagggcataggttatctgtgatttcaaaaagctgtacggcttctttccgtcaaaggttttctgcgacataaaccatgtgagagcaacgggaataccaaagtatttgagaaatgctccctcaatcatggaaagtgggggaatatccccaaacagaataatgagaaattccgtaatcacaaaccatgtaatctgtgtaaaggtaacgggaaagggtaagttaaagtcattgattgcatacaagactttttccacgttccagatacccgtataagatttaatctttttcaagttctttcagctcctttcgtaagtttctaaatagaaaaggacagccattttcagactgtcccttaaagagaaatacgctgtcagtaacaacaatgcttgtcgctgatcttccagcgttaatatggtatctcgcacatacctcggcttgtttcaataaagcaaccgcccatatccaaatctcgcccgtaggcttcatagtcaatgtaattctgtaagctgggtggaatgtccccaagtgcctgcaattcgtctatgtagtaataggcaacgtctgtcatagtttcacagtcgggataataataaatatcgtccttgtgttccacgacttcttccagcgtcccgtagtggctgataaattcgtccagacactctacaatatagtcgggaagttcctctatcatttcatacatctcattgagttcttcaatggaaacatactcgccaatcgcaatggggaagttgtcggtatcatggatagcgtattcctcatactgttcattcaagccgattttttctttcacatcttcctcgtcaatggggaacgtgaaccaagcaccgactaaatagccctcattgtatttgccaagattagcaatgtaaaccgccatatcatcaatcataagcaccacctcatttcctactctggcagttcaaagataccgtgttctgttactaaaaatttcccgtgttcctgcaagtgagaagcgtaggcttcaaagtcaaagtaatattcttgacagtcctcggataaatgcttaaatgtcgggtcgttcatcagcttttgccttgcaacatctatcatgcttttgcagtcgggataaaccgtaatcacgttcctgcaaatataaagtgcttctaaattttcatacacggtaagaagtgatacatattcttcctgcatatcgcttgaaagctggcggtacataaaatctaattcgttgagctggtacacgcttgtatgttcgtggacttcatcagcaaagggcagtaccttttcgataatgcggtaatccccactttctgcaccgacacctaacttttcttcaaactctgcaacatctatcggcaggtcaaaccagtatgatgttgtttcttcgccagttgttcctttcgtttccaccagcacccttgtttcctgcattgttcctcacgtcctttctgttgtttcatcacatcttgtaaggtctggtacgacataccaaacacatatttagaaaaatcttctaactgtctttcttcataatcggcagggttcagtcgtttcatttcctgccacaccttacgcttgtaagagggcaggtcggaaatataatcacagccgactttcgtctgcatatccttaaaaatatcgctcatttcatcactccaatctaaaatttaggtaagaaaaaagcagtcaatcctaagactaactgctttgtgtgtatggatatgaaattgtcaaactgggatttatcaatataaactaccatggaaaaatataataaaataccaaagtacttaatacaattccgacaatatacatttttctatagtttacttttttgaaaaatattatggtaaacacaacagctcctataatatccattaacaactgaaataggaatgtttgatgttccaaaaaataaataaaaactgctattgtttcagcaaataatgctcctactggtaaagaatataatactgaactaaaaatatgttccctattccaatagtacagaataaatgctgctattgcacaagcgattgaccaaacagtaaacaatatgaatagcccaaagcggaatccgccggaaaacataggtataaacattcctaatattgcttgtaaagcataaaaacttaatgtcattccaaacatatacaagaacgaactaattcctgcacaaatatttgaggtgcttaacataacgatgatagtattggtaataatccaaaaaccaaacaatgtttgaggtgatgaaaaactccatagtgtatctgcgggaaaataatctaacagtctacatatacaccctactaatataccaattacaaatatcgctgtataagacttatatgtatttcttagttttatatttgacacaatagttttcctcctaagttcaaattcatatttgtcgttttcttcatatccatattatatcactcacatattagcactacaataaaattttatgcaccgataatcttgttgaacagctctaacagtacatctttcacaccgccggcattgaataccaagccgacagcaatcaaggcaactaccaagaagccaatgagctttgaaaactcacgcttgaaccctaagtagataccgataaccacaatcgccataagcactaagctctgtgcgtttgataaaaaccattgatataaattttgtccgaaattcatttaattgtcctcgctttcttttaattgttccatttcatagtcagcttctttgccgacattcaaaatacacatcaagactacgccgatacccattcccatagataccagcaggaagtcttttaataatacccacattttttatcactcctaactttctactaaatcttttgcaggggtcgtctgctgtttgattatcatttcatgcttttctgtgagctttgcctgctgttcgattgtttccatgtagtctgtaccgtttcccttatcaatctttttcagcatttttaaggtcggtgctacctgccgttgtacccaccgcaatgtgcggtctaaggtgtaaggctctggttttgtcgtcagcttcaagctctgtctgttatcgccgataaaccaagcccagcggtcattgagcttccagtcattttttcgcttgtcgggttcttcatcaacaaaccgcacatactgattgatgatagaaaaagcggtctgttctgcgtcataataggtcagtaaatctcgtaccgcataataggctcgttcattgcgaagccgtatttcaaaacggttgataatgtcggcttcttccagaggtgtccctaacttgacgtactgctcatagtccttttcatagatacagaaatacacatctgatttcagcgacccaagataaagggtacgccccatatattctctgtcgtcctctctgtgcttgataagctcgcccgactggtaaaacttatagcttctggactttccgatatattcccgtttcctgcatttttccgcaagctctggaatatccaaaatgcccgtatggtcgttgatagcaaggtcgatacgcttcatcacgccaccgtctataagtgcgtccataagaaagtcataccagcttctttgctgtgccagcaggtaactttcaaactgcctgcaaccacgcccctttaactctaaaaggacacctttttcttcgtcagccgacgtatagataaagatgtcccctaaagagtaatgctccgtataactgtaacgcccgtaattttcatggagcatatagttgatattcagttttaatatatctttgatgatgtgctgtatatccagcgtgggaaaacgaattttcacataatcaaacagcatggtaagcggtgcttctggattgaactttgccagttctttatgcagagtattcagaagttcctttgacggcttcatttttccgctttctatcttgttgagatattctcttgtgataccagacgccaccgccagcctgccttgtgagataccgtaagcaatccgtttttcccgtaattcttttatccattgttcttcattcagaaccatacccccaatctgtcaagtgtgaagttttttaaggcgacttcacagccgatttttgctaggaaaccatgcgataagccttatgtttcctgtgtttttcgtctattgtctatttgcaaacgtacccctctgttagataccgaggggttttacctgctggcgtggcttacgccacaccagcaacggctagtccgtgccgtcgcctttcgcttcgcacgtcgccgtcccgtcctgccttgcttgtgcaagagagccgatagtctgcaaaaaatcatgtcctttcgggactaaaggcgtgtaaaattcgctgataacacttgttcccacatcacaatagccacgccccttgatacgcttctggaaaaactgctttttcacatctgaaccgaacagcataccgtagcctaattcgctgatacgccccaaccccacacggaaattaaagttatcccttatcccgtccgagaaatactttgcgtctgggcgctggcaggcgacaataaggaaataacctgcttgtcgccctaacataacgattttctttagctggctaagtaagctcacgctttcttttgtccccagcatttcaaaaaacgccacatattcatcaaagataagaaagcagggtggcagtcccagataggcgtagttttcgcccgtcttatagttcgggtgtcgcttcatttcctcgcttcgttgtaccatgccctcataaaaggcattgacacaatcaatcatttcttctttggtatgatacacatttcccatgactgttcctaagtctgctaagtccgcatttttcgggtctaagatgtaaaggacagcgttggtatgcagtagggcttcaatgagcgtcagcagaaaataagttttaccgccacccgttccaccagcgataagggcgtgtggaagtgcgtcatattcccagacaagatttttcatcagtctaagacagccgttctctgcccgtacttcatcaatggtaatgcggttcgctatcatatcataaagtagggtatattcgatataaccgtcatgcagggtcttgtctgtcagctcacaatacaagccactttccaacttatcctccaaccgtaaaagctggtcttgatattttcccagcgtaatttcacagcggatatgaagaagtcctttttccatttgataataaatctttggaaaccagacgattttttcccttgatctgctttgcaggtcagtaaaaaaaccgctgtcttgtacggtatcggcttcataccacttattttccagtatcattcttgccagcttttgacggtgcagtagcttcttgaaactgtcgtaacagaagcggtaatacccaaaagcgaccaatgcacaaacaccagtcgctatcaatatggttatgaagttgtaaggggaaagcgtcaagccgttttctaacaagctgaaatgctcccagtcggtacgcatgagctgtttgctattcagtagcaggagaactgccacgaacacaaacagaagcgtctctatggaaaaatgataaacaaggtgcttgtcgctggctctgatacggtgtcctttgttccaaatcatacgcataaatcaatcactcctttctgggtatgaaaaaagcagtcaatcctaagactaactgctttgtgtgtagggatataaaattgtaaaactaagattgcatttcagatatggatttgaaacccctcatagctgaatataccattcccttgttttaatttcccttcatttgacaagttgtgaaaagctgtctctatcttgtcaattatagtaactggaatagataaatgatgatgtcctggcaaaattcgacttatctttaaagattgaatttttctaacagacttccaaaattcttgtgggtttgttgatggataaaaagcatcaaggcaaccgctatatatcaaatcgccggaatacagatattttctatccgcttcatagaaacaacaatgtccgggagaatgaccgggcgtgtgaataactaccaactttctgttccctaagtcaatacaatcttcatcatgtaaaatcatttgcggaaccccttgaaaaatctgatatttctctaccttaaaatccgaggggaaatcacatggattgcacataatattgttttttaccacttgcaaaggtatagggaatttgaccgatagccattctttttctgcttcatgaactgcaatagaccgaaaatatttatgtccaccgatatgatcccaatgaacatgagtagtgattactgtaacgggcagtttcgtcaatccatcaataacctctctgatgttggaaacacctaaacctgtatcaatcagaatggctctttttgtcccacacaatagataacaatgtgtttcttcccagtgtttgtattcgctgatgacgaatgtatcttggtctatttgttcgacggtaaaccaactgtccatatactattctcactccctaaaaattttaatttgtcgctttcttcatacccatattataacagttccgtatatcctctacaacgaaaatctattcagcaagtctattttttcggttgtccctgcggtgtatggttctgtgtattgcctgcgttctggttgcttttattcttcaacacaatatcctctgcctttacataccagtccacgtctgcacccatataggtttttcttgataccgtatcggctactggattgacaagttccacaactgcgttgtaaggaaattcccttaacggcacttctggcggtacagacacggggataattccaccatgcagactgcacttcaaatcatagatacgttttttaagctgggtactcggtgtcccgtcctcattctgcaagaacacatcacgcaccgctgtaaactttaattctccaaatgttttctctttgtcaatgacaaacccgtttgataatctcataaatttttcactcctttacttttcttcaacttcgacaatatcatcagcaagcaacacataatcggtatgtcccatatccccgattgcgtaacctctgccatataactttggattaacaagttttactttctgctcatacttgaaatgcttttcgccagcctgcacgggaatttccaccacaacattttcgcctttctgtacgtcagaataaaggttatagcttcgtctggctaagaccctgcgattatttttatccctttcaaagataggctcgctttcgcctgcatattcaagtgttccaaaagactgtgccatatctggcacgacatatttcatttccatagtgttttacctcgtttctttctattttttgattgattagttttgtttcttattctggcggttaaggaagtaccagcaatcccccgaatagtaaagggtaaaataaatgcttacgcacccttgactatccgtgttcttgcaggtgcaaggcagacaagccagaataagaggaagtctgccgtttgacagcttcggtggagaacgtgatttttctttcattatatcgttaccgccttatgattttttcactttacggcgtttgtaaagatatgttccagctagtccagcaccagaagcaatcaacatcacgataaatgccataagatttgtgttgtcgcccgttttgggactgtctgttttctttggtgtatcgggtgtctgtggtgtttctggcttctctggttcttcgggtgtttctggtacttctttgatagtaaccgtctgtccgtcgtcctcaatgtctttgtgttccgtaacctttttcggttcatctggattgcttacatcgtacaattcttcaaaggttacaagctgtttaccgccaagagaagaagcgtcgaatgtaaatataatttctactttcatgttttctttatcagcgataaaggaatagtcgttctctacacgctttccattgataagaagttcagcgttttcttcttttaacatctgccagcctacaagtttgtactgtgtgccgacttctaagccctctaaggttacggtatcaatgattgtaacgtcttttccagcttcaatctctttgttgccgtctttatcggtagcggtcgtatgtattttgatgatacgctctgtgataagtaccgtttgcccgtcgtcgtcaatgtccttgtgttccgcaacttttacgggttcgtctggattgctcaaatcgtataattcctcgaatgttaccagatttttaccgccaagctcggacgcattgaatgtataagcaatttccactttcatagcttcatcatcagcgacaaaggtataatcgttttctacacgtttcccgtcaatgataagctcggcgttttcctcctttaacatctgccagcctttgagctgatactttgtgccttttgtaagtccgtctaatttgacagtatcaacgattgttacctcttttcctgcaaggatagtcttttcgccgtctttgctggtcgctgtggtatggatagagatttctttttcgtattcatcagtcagcgttcctaaatcaatcacaaggttatttcttgataccacgatttcaaaaggtgggataagttcaaagtccttgttactatcgcaacgcatttcttcaatgatataggtatcataaggtaatgcccccttgctgtcgtctggttcagaagtcccaaaccacacaccgtcctcactggtcttgcctgcgtttgtattgtgcttatgagaagcccagtcagcagaagtggaaaactgcccgttatcatcagttaccacaacatgattttcgcccgttgtcttgcttgtgatcctaaaaggaacatcagcaagacgcttgtgtgtgcctgcaccgatttttacaccctcaatatctccacgcttaatttgattatagatagaatgggcttcgtcggttaagtccacgatttttccattttctgtgattgtaaaatcaatcggttttgcaccatcagttaagtaaccgtttggagcttcactttcaacgatacggaattttccataaggtaagaggtcagcagaagtagaagcgataccctcaatatctgtacgaattgtctttaccacttcatttttcttatataacttgccctcaaccaaaacagaattatcatttaaggaaatgatgtcaaaggcagtatctttcaaagtggcacttccttgtggctttgtatcgcccgtttctaaatctcgtttctgaattttgacaccgccacggataaccttgtcaaatacggaaaactggttacttccagataatacggcaaggtcgccgtcctcggtaatctgtgttatatataagcccttaatctgttcggacttatcgccagcctgcatatatgcaccgtcaagcaagtagccgtttggagcttttgtttcctcaacggttagtgtcccaagtggaagaactgctttaccgtcctgcatatagaaactgtcgccagatactttgtatgtgtccgctaattttgtgatgtaatgggttgtcccgtcgctgtctgtttcagcgattgtctttgtaacccatgtacgagtagcttcggcagggagattgtctttgttatagaagccagcataatacttccatgtaaattccgcacctgctagagaagcgttcccctgcggattgtctttctgtgtttccatatcaatcttgaaaagttcaatcaaagtgtccgttacctttggtgtatcagatactttcaaagttgctgtctttccagcttcaacctttaaggaatatacagttttatctactttatatcctgctggtgcggataattccttgatatagactgtgccagcttttacctctacaacatctgtatttccgttttcatcagtcgtaagggtggcaagctgtttcgtacagtccttatcagaaaagacaccataggtcgcacctgcaatagagtaattcccgttaccgtctgtaatgctggtattactggaaaccttttgcagtttcgcatttccaacatttaatttcgcccagaattgccccaattcctgtccctcgccagagtagatataaccgccacattcatagcgtcctttattttctttgacaaaggcttttgcaccaacgaaaacttcgtcctgcgttgcctttggtatttcatcataagaagctcgcacgttatcacattgccagccgagatgtacgctcaatctctgccagactacaagctgtcttaaaaggtaagcgtgatttttacttattccgctgtggctgtctgtgtactgttttacatattcgatagataaggcaacgtcgcttatctggtcggcactcatacgggtgcttgcgtcagctctggtcttgtaaccattcttaaagtctgtgttaatgtcgatacagtaagcgtcctcgccctcaacggtcaaatgtccctcattaaaggtagaaccaatcgaaccgtcattcattactttttcgacgataccgacacgctcttttgactccgtccagtattgcttactttctgcatgaacgggtgtagtcggtaaagcagtaacgacagttgcaagagctaagaagcccgtacacaatcgtttcaatgtctttttcataaatctaatgctcctttcattcgggtaataaaatagccgtccaataagaacggctgaaaatagaaaaggaacgtcatgttaggcgttccatagtctataagttattcaatttttttcttgtttcaatactgatgtgctgtaccatatctttgcatatctaggaaaactggcgtatcaaggctcattcaatggtagtaaataagtagtaaattgatgtatttgttcccttgaaaatgctgatagatactgtgttttagcggataatcagatttttattgtgtttttttataaaaaatataatatttattttttgcatttcacacctcaaaaacgacatttcacacctaatttaaaaataaggtgccataaatagtaaaataaagatgtacatggaattatttactataatctattttaaataccagagcaaaaaaagaaaaaatgaatgtaaggataagtaaaataatggcaagtatacttacgttatgataatctttacacaagtgcctgctaatgtatttgcagcagacacttatatttgtaataaatattgatggttgctgtaaagaataaaataaaaatgtaggaaaacctataaaattatttagtctaaaaccgacatttttttaattgacatgtgaatataataatctaaaataaaatttttaatgaaaggggttgctagtatggtagttgaaacaataaaaaggtatccattacttgttatttttatgcttgttttattacttgtgatgatttttgcaattgtttattatcgaatgtcaaaaaagtatgaaaaaagtcaaatagaattaaaagaatctttacttgcagcaacgacattaaatagatgtattcatgctttaacttatcatagtgaaatcgatgatgctattaatgatttgttatgtcttattactgagttttttcaaggtgatcgtgcctatatttttcaaatagactatgagcaaaatacgacatctaatctttttgagtatacagaagaaggggcaactccggaaataaataatttgcaaaatgtttctttagaaactattcaatattggttagatcgttttaaggttgatggaacattttttttaaaaagtttagaagatgaggttgataaaaattctgaaacctatcgtcttttaaaattacaaaatataacgagtcttattgctgcgcctttgatagaaaatgaaattattactggatttttgggtgttgataatccacgaagaagatatgataatagtagcttattatcttcggttgttttctttgcttctgagagtatgaatagaaaacaacaggaacaaaaattaaaagcaatgagttatttagattcaatgacacatatttttaatcgtaatgctttgatagaacgaattgataagattaaaaaaagtcaaaataaggatattggtattgcttattttgatttaaatggattaaaaaagatcaatgatttacaaggacatttggaaggggatgctgttttaaagaaaacagcttatttgatcaatgagtgttttcctagaaaagcttatcgttttggtggagatgaatttgttgttctttcaataggaattaaagaaagtaattttataaaacaagttgaacaatcaaagaagtatttagaacaaaatggtatttcgtgttctgtaggtgtttcttggtgctataatataaacgatgttgatgaactcatcaaagaagcagatactaaaatgtatgaaaataaagcaaatttttatgaaaatgaaatggttggtattgaaagctaaccatttttttatgatataataatgttaatgaaaagagatgagactatgcaaaatatgaattattattatgacttttctggtcaaaaatttgaatatccattaagtctaagtattaatcaatttgatcgacaagttttttcaagacaatcttctttagaaatttcttatgttttaaaaggaagttatgaagttattacagaaaaaatgtcgactgttatttatgaacatgaattagctattattgctcctaatgatattcatatgttaaagatgaatgaaaaagaaagtattattttaacattacatattgatttttcttatttacctcattatatggtaggagatatagatcatagttttcaatctcttatttgtagagaaaatcaaaataaatctctattatttcaaataaaacaacaattaggcatcttacttttacattttattgaaaacaaagataacatctatttattaaatttagtaatatcaaaattaatttacatgattagtcagaatcaagaattctctttagaaaatttaccactttcttctaaaaatcatgaaaattatatgaaagctattttattcattgatcaacattaccaagaagatattcatttagaagatgttgctcaaaatctttcttttagtatctcctatgcttcacgtttatttaaaaaatatacaggtgttagttttgtaaaatatttatcaatggtaagaatacgacattcattagaaaagttactagcagggaaagactcgattgatgagattgcattttcttgtggaatgtctgcaaaggcttatagtcaagcatttaaagacttatatgggattacaccaagtgtttatcgtaaacaatttcaaaaaaacttgaaatataataaggaaaataaggaacaaagaatgcatttggatcaaaaacaaatttccttgattcaacatttaataaatgatcatcatctatatcaagatgaatatcttgatatagataaagaaaatcaacaaagcatatatttatttaaaaatatagaccaactctctttattacaagaaaataacattttaactattaaaccaaagaaataacaataaaaacaattatttattgttatttttttacttttttaaaaaaataaaaagaaaaacatcaaaaaattgtctatataataataggaggaaaaagaacttcagccttccaagctgactacgtgggttcgattcccatcacccgctccatgaaggagctaacacacttactatgtaggtgtgtttttttattaaaatgatgaagtatgatgcaacttagatgtaaggtggaaattgaggtgattccatgtataaaatattgattgttgaagagggaaaacgattagaatcaatgtcaatgaagttattggaattgattgttttaaaaaaacaatattttaaggtgtataggatttctgcaaaagtttttttccaaggaattgaggatacagtggatttattgatgaaagaaaatcatattcgattttctactataattgaacctggagagctctctattgaaccggatttgataaaaacggtgtgtttaaatttacttgataacgcccgtaaagcagtaggaggaaatgctagaatatctttaaaaggtcatccagtagaaagggggtatcagtttataattgaagataatggttgtggtatggaaacaaatgaattaagtaagatcaaagaagcatgaagaagtgtaaatacagaatgaagtttctgcttgctgtcactttattgatcattatcccattagttccattaacaacttctaaaatacaaaataatcaattaattggacatcttcaagttgaaaaaataaaaaatgagagattagatgtttaaacgagtaagctttcggttgttaaaaaatctaggcattttgacagaatttgattttaatgaaaattatgtatgttacaactatacagtgaaacgatatagtaatgttttagattcttaaaaaaatgtatgtgtttatcaagtgggttttacaaatgaacaaggattttttaatgctataaatgatgcagatacacatttgatatatcaatatgattattacaataaaaaacatggcgataaagaaaatatagaaatatatacttttggaagaaaacatttaggtttaactgaaaaagaaatacataaatatttatttaaaatgggtgataatcaaacatatattacagatagttctagttattgatacaactttgatacttctttggtgatgtttctacgcattttttttatacactgaaaagtgtaaaaaagatgcgttttttattgaaaggagcacaaaacgaaaaaaataaaagtattagttgttgtgtgggtaattggtggattgattacaagtttatttttttaatgagtaaacaacttcagcaaaatagtaatcaattgtttgctgctagtaaaatcaaaaacaaacaagaaaattcagacaatagtgttaatcacgatgaattgttgacattggttaattatgaaaataatctacctgaaaattggaaagttgatttagtatcgttgaacaatggacaagtagttgatcgacgaatttataaagatttaatggagatgttacaaacggctaaaaaagaaggtttaaacttactgatttgttcttcctatcgaacacaaaaaaagtaagaatatctatataaaaacaaagtaaatcaatacttaaatcaaggatattcaaaaacagaagatttagataaagctgttttttgggagcaagaccaaaaacaagtgaacatcaattaggtttaacaatagatattgtctctatgaaaaatcaacgtcttgatcctagtcaagaaaaaacagccgaacaacaatggttgattaaaaatagttggaaatatggttttatcctgcggtatacaataaataaaaatagtattactaaagtaggctatgagccatggtattatcgttatgttggaaaagttcacactaaaaggatcaatgaattaggaatatgtttagaagaatatgtaaaaatgaataaataagtacataatattataaatagagaactaccgaaaattttatcggtagttttattttatccatttaagaggtgggatttgaatatatttttgaaggagaagaatgagagaatacaattttttattatattttactaatcttatccttttttttgttaaagaatcttcatggaaatgtacaagacacatttgaggaaaaagcgcataacataaaagaatttgtagatcttttgaagtgagattatattcattgattatttgttctaattgattgattgtgattgtattgtttagatataaatagaaaatatcatgaatgtataaattgaggtttatattctctataagataaacatcttcatatgaatgaatatttttgtgttgataggagaggttaatggctgttgtggacaagaaataatgatttaaaagttcgatagaaagctgacaaagagtaaatagagaataatagatgatttgatattctagagaatttaaaggtgtatagataagaatagattcataatattgaatccactctttttttatttcttttattgtttttgtttcttgagggatgagtgatagggaaatgatttttcggatatctagaggaatgctttgtacttgataaaggatgtatccttgagagtttttttgttggtaaatattattaatgattttaaagggattgatttgaagtaaagaaatatatttttgataatataaaggaaaaggtttatttgttaaataataatgttcatcttcataagtaaatgaaaattgatcttctaaaggaagatgataatatgtttttaaaatacttaattttgataccatgagggaacctcaccttcaatgacttcataaacaagaggaatcgtataattttctttaaaatgttcatgatataagggaacaagaatttgtaaaacaattgtaacatttaaatcaatagagatagcaagatgattgatcccataatttttaatttttttatcaatatttgaagaagttaaagaaagtgttttatatttaatggaaaaagatggacctcgatcttgtaagaaaatattattggtaagagaaccgataggtatacgtgcaacaatacctttttgttgattgatttttaagagttttttattgtatggagaatgattgttttcttggtaagagccttcttcaagctttaaaagagtttcttcaagattatggatgtaattagaggcaatatcattgatataattcatttgaaaactgatggaattattttcttttttatagagtttatgtgtatctattttttgagtaaatgaagtatgattgataagtatctgaataaattgatttatttctttactggcaatattttcaattctaggggtcatacgatttgaaaaaagataagcacatataaaaagtgaaagcataattaaaatatatttttcttttttcatcatatcaccattataaaatatgtaaaaaaaaagaaagtagaacaaatctactttctttaattttaataaccaggtttacctaataatttgaacatatttttcttataaacttcaacaccaggttggttgaatgggtttactcctaagaagtaaactgacattgcacatgacatttcgaagaaataaaccatgtaaccaaatccataagcatccattttatctaatgaaataatgatgtttggtacattaccagtattaacatgagcatcgattgtaccttcacaagctcttttgttaacataatcaactgattttccggctaagtaatttaaaccatctaaatcatctggatcacttggaataatcatatcattttgtggatttttaacttcgaagattgtttcatataaaactttagaaccttcttggataaattgtcctaatgaatgtaaatctgtagagaatacagcactatgaggtaagatacctttattttctttaccttcagattcaccgtataattgtttccaccattcagcaacgttatttaattgtaattcataagttacaaacatttctgctgaatatccagctttatttaataattgtcttgctacaccataacgataagcatcatttgtttcgatgtttgcatcgttatatttaaccattgcatctttagcaccttttaacatttcatcaatatcgataccagccatagcgatagggaataaacctacagcagttaatactgaataacgtccaccgatatcatcaggtacaacgaatgttacataaccttcatcagtagctaattttttaagagcacctttttctctatcagtagtagctacgattctttcacgagctccttctttaccatatttcttttcacacatttctttgaagattctgaaagaaatagatgtttcagttgttgttcctgatttagaaataacattgatagcgaaatctttgtcttcaatatatttagcaacttgatgaatataatttgaagagaaagtatttcctacatagatgatttcaactttatcatctgaatataaaccattgattgcttcaatagcagcacgtgctcctaaataagatcccccgataccgcatactaataatacgtctactttttctcttaatttagcagcagtttctttcattaattgaacttcttctttgtcatagttttctggtaattcaacccaaccaaggaaatcgttaccagcacctgttttgtttcgaatcatatcatgaatttctgctactttttctttgtatgatcctaaatcttcagctaattttgcttttgataaatctaatgtgatcatttagttttcctccattacaccttgttttaaccattcttccattgcttgagctaaaggtaaaaaacctttaggtgtttctacaattggttttcgtggatttttatagacgagtttcttgtcttttcttcgaaaacgattgtcaacagctttcaagcttaatttggcgtgattgctagaatgatcaaaatcaatgacttttactttaacaatatcattaatatgcacataactggcaatacttttaacaaacttatctgatatttctgaaatatgaattaatccagttgaattgtcaggcaagagtgcaaaagcgccataaggttgaataccggttattttaacatcaatgatatcccctcgtttgatgagttttgtcatttgatttcactccttgcggcactattatagcacaatttaagcatatgtgttgtatttaataaggaaaaaatataaaatatggtaggatttatatgatatacttaataagtaaaaaaggagtttgcaaaaatggaaaatattgaagaacaaataaaaaatgtcattcataaattaagaccttatctacaaagagatggtggagatattgaatatgttgattttaaagatgggattgtttatgtaagaatgctaggagcatgtgctggatgtacaatgattgatgaaacattaaaagatggtgttgaacaaattttaatggaagaagtacctggtgttttagaagttcaaaatatttctagtacattatagtacaaatgtcttgcatttatagagagtttgtaatattatgttttagtcgttgaattcatcataaatttcaatttatgaaacacacttattttaggtgattaaattgaatgatcgaaaagaacaacaaatcaaaatcgctcacattttgaaagaaattggtttggaagatgaactcattgagaaaatgacatcattaaaaaaagaagaatatcaataaaataaaaaggactcttattaagaaccatgagatgaagatcgatgaagtggtggcaaccctatatgttagaaggtgcctttactgagcaagtttattcttgaacaataagagaaagcttcctaacggctttctctttaggaagcttttttatttgttatttaaggaggaagaaaatgaaagaaagaattttatttacgtcagaatctgtatcagaaggacatcctgataaagtatgtgatcaaatcagtgatgccatcttagatgaatgttttaaacaagatcctaactcacgtgttgcttgtgaatgttttgcgacaacaaacttagttgtcattggtggagaaattactacaaatgcgaaagtggattatgaagctgtggcaagaaatgttttaaaagaaattggctatgatgatgaagctaaaggaatggattatagaacttgtaaagttgaagttgtcatggatagtcaatcaagtgatattgctcttggaacaaatgaagaagttggtggagcaggagatcaaggtattatgtttggttatgcgacaaaagaaacagaagggtatatgcctcttgctatttcaattgcgcatcatttagttcgttacgcttcaactttaagacatgatgggacttttaaatgggctagacctgacatgaaagcacaagtgacaattgattatacagatgaaaaaccagtaattgatactattttaatgtccattcaacatgatgatgattttgatgaagcagaatttaaaaaattcgttaaagaaaacattatggatgccgttgttaaaaaatatgatatgaatacagattatcgtgttttaatcaatcctacaggacgttttgttattggtggtcctcatggagatacaggtcttactggaagaaagatcattgttgatacatatggtggatatgcacgtcatggaggaggagctttctctggaaaagatccaacaaaagtagaccgctctgctgcttatatggcacgttatattgctaaaaacgttgttgcagccaatatgtgtgatgaacttgaaatccaattatcttatgcaattggtgtaaaagaaccaacatctatttatattgatacaaaaggaactgaaaaagtacctcatgatgtgattcttgaagcaattaaacaagaatttgatttaacaccagcaggaattattcataccttaaatttaagaacaccaatttataaaaagacagcttcttatggacactttggtagacctgaagcaaatttaccttgggaacaattagataaggtagaaaatttaaaaaaatatatgtagaaaaaggctcatgaattgagctttttttgttatgtgtgttttttaaacaggataaaaaagcatattaaagtaggaatttagaaaagtttatagtataatatagttatcaaaaaggaggaattaattatgaaaattacattaagaggaaagaacattgaaattactgaagcaattgaagaaaaagtcagtgaaaaattatcaaaattagacaaatacttcattgtaagtgaaaatgttgaagccaaagtacttgtaagaacttatccttacggacaaaaaattgaagtgacaattcctactgaatatgtacttttaagagcagaagttgtggatcaagatttatacaatgcaattgacttagttatcgataaattagaaggtcaaattagaaagtataaaactagattaaacagaaaatctaaagataataaacttgcattcaatttagcatcaattgaacctttagaagatgaagaagaagatgtattagtaaaaacaaaaacaattactccaaaaccaatggatatggaagaagcaattatgcaaatgggattaattggacattcattcttcgtatatcgtgatactgaaacagatgctattagtattgtataccgtcgtaatgatggagattacggtcttatcgaaactgaataggtatgatgtaaaaacactaaccaactataataggttagtgttttttgagacaaatttgaaacaaatttgagacaaaatagcttaaaaaatgatgtataataatagtgtaaaaaaatagtccagaaaaactgggctattttttatatagatcaccttgataaacatcaagttctttcatttttttatcaatatcatttaaaatagttacctttttaatggaccataaaggagcaattaaatcatcgattttaccatcaccagtcaatctttcgataacgatttcaggtttaatgtaacgaagttgttctactacgatatcaatatattcttgacgagagagcatgttaaattcatgattttcatacatttgttgaagttttgtatttttaacaacgaataacatatgtattttaagtgcttgaatatctaattgacctaaggttttagctgtttcaatcatcatttcttttgtttcaaaaggaagaccattgatgatatggacacatacttcaaggttgtattttctacataatgctaaaccgtccaagaattcttgaaaagtatgaccacgattaataagtttacttgtttgttcatggatcgtttgtaaacctagttcaatatagacatctttttgtttattgatggtacttaaatattgaacgatttcttcatttaaacaatcaggtcttgtagcaagggcaattcccttaacatcttctttgtttaaaaaaggggcaatcattttttttattttatctaatggaccataggtatttgtattggcttgaaaataagcaatataagcacattcaggccattttcttttcatgacttgagagattgtttgaaattgtttttctaaatgatcatgaacatttccagcataatctccagatcctgatgaactacagaaaatacaaccaccatagccttttgttccatcacgattaggacaggtaaaatcagcatttagtgcaactttagcgactttttgatggtatttgttttttaaataatagttataagtatgataacgtttgttatctaaagagtatttaaattgattcattttatcaccgaagcaattataacataaggagtaagaaaatgggattagagttaaagaatgtcacaaaaaaatttaaaacaattgagggagaaagagttatttttgaaaatttgaatatccattttcctgattatggtttgattgctattacaggggaaagtggatgtggaaaatcaacacttttacaattaatagcaggattggatcaagactatgagggaaagattctttttaatcaagtaaaaatagaagatattaaagattatcgacaacttgttattagttttgtttatcaaaattatcagttaattgattatttgagtgttaaagataactgtttattttattgtcacttaaaaggaataaaggttgtagaaaaacagttacaagaattattagaaatatttgaattaaatgaactagtaaatcaaaaggtaaagaatttatcaggtgggcaaaaacaacgcgtggcccttattcgtgctttattatgttcaagtcctattattttatgtgatgaaccgacaggagctttagatgaaataaatcgtcaaaaagtttatcgttttttaaaaaaagcgagtcaaagacgccttattcttattgtttctcatgatcaaaaaatttcaaaatatacaccttatcatttaaattttgaatgtttaaaacatcattatgattggaaccatcaattatattcacgttatgaaataagaaaaacaaaatgtggattattgtttaaagaaacgatccaaatgattttaaaagataaaaagaaatgggtgataatgtttgtttcacaaatttatatggtactagcaatgacgctcattattactggtttagaaggatttaatggttattatcaaaaacaatataatcaagcaatgaataataatttagttatgattcaaaagaaaaatcaagaaccctttaaagaaaaagaaataacaaaactgaaaggaaaatatcaatatcatttagatataggaaagattgaaggccttaaaaactttcaatctttttcaattaacaaaaaaacaaagcaaaatgaagtttatgtcaatcacgctttaattaccgaaataaaacaaaataaacttatttataaacttaatcatcatcaatatacattaaaaatcaaaggagtaattcaagatgattatcaagaacctgttctttattatcattcattatccaatgaaatagcccttcaatgcattgatgtttcaacgtgtattgtctatgttaaaaatcataaatatatgaaagattatttaacgcatttatcagttcaatatcaaggtatagcacctatttatgaagaatatgaaagttattttaaagttattgatctttttaaaaaggttagttttgtttttatttttttaagttttatgattgcaatcgttttaatgggatatatggttttatcgatgttttatgaaaatcaaaaaatatatgccatcatgcttgctaatggttatcaaaataatcatttagcattttttattttaaaaaaaataagcttaatgatgatttcaattggaatagtttcttgtttggtttctagtggagttttaaaaatcatttcattttttgatatttctaaaaagatctggggcataaaccatttgtttgttttaccaagagagtttcaatggccatttacgttatatttcttttatcttttgggatatatcgtgcaaggaattttattaagtctatttatagttttaaagatgaaaaaaataaaaatgtatgagtgtttaagggaggaataggatgttagaaattaagaatgtaacgaagtcttttgatcgacctttattcaaggagatgtctatgacatttcaagaaacagggatgtatgtcattgttggtaaaagcggtagtggcaaatcgacacttttaaatattttaggaggtttggataatgagtatcaaggtgtgattgaaattgatgggcaagatattcgacaaataccacattatattagaaaatacattggttttatttttcaacagttttatttaatagaagaaatgaatgttaaagaaaatgtaaatctcatttcgtattttaaaagaataatgatttttaaaaaagaatattatttagaacgtttaaaaataaaagacttacaacgttataaaacagcaattttatctggaggtcaaaaacaacgagtcgctatttatcgaggatttattgctaagcatcccattattttatgtgatgaaccaacaggtgctttagatgcaaaaaatagtgaagaaatttttaaaatattaaaacaactgtctaaagaaaaattagtgattgttattagtcatgatgaaatacttgctaaaaaataccatgattatctctatgaaataaaagattatcaattaaaattaattcatcaaaatccaataacgcaaagaaaaaaacaagaagaaaaaacaagtaaaagatcttttttacaatttatattgaaagaattgaaaatgacgtggaagagttcttttattgttgtacaagttttatttttagcacttttgagtattttattgaccctttcattgactcaatcaacacaaaaacaaattcatcagcaattagaacaaattattccttcaacaaccattatgttaaaaaagaaaaataatcaaatgatcaagatggatgatttgaaacaaattcaacatccagcaattcaataccgttttttacaaaatgatcaggtggattttttaggaatctctttttctaaaaaatatcaaacgaaaaaaacactttatatttctgattatattcagcaaccacaaaagaaaattcaaggaagaaagataaaaaatgctcaagaaatcattttatctaagtctacttatgaacaacttttatatttatcgcatcagaaggatttaataaataaagatgtatatttgttttttgaatatcaaaatagaatttgtttttataaagttaaaattgtagggattgaaaataaaaagactttaatggagaccgtttattttaatgaatatgcaatgagtcaaatgttaaaagaactttatcaaatagaagtagggcaaaccgcttttttacaagtgaaagataaaaatattttaaaagatttaaaaaataaatatcctttatatcaattaaaacttgcaaatagttcattatcttcaagcatcgatgaaaaatttcaacaaattgaatggatcctttattgttttagttctttatcagttgtaacagcttgctttttattaggtgttgttttatatttgatggtcattaaaagaaaaaaatattttgctattttacaaacattgggggcttcattatggcagatgataactcttgttttgtgtcaaggtctaggtatttcctgcacagcatttatagaagcaatgattgttttaaaaaagttatttatttttgctaatcagttgattcaaaaaagtatttcagatttgatggatgaattttttgttatacaaaataatgtgcttttaggtgtttttataggagtaattattttaacattattatgttgtttgatcccaattaaaaaagtaaaacagatagaaattatagaagctttaaagagctaggaagttttttattgcataaagtatgtgatgtggtataatagaaaagcaaaatcaatgaataggagtactagcaaatcccctatatttagagagtcagtgggtggtgcaaactgattatagtatttgtgaactcgcctatgagatgtatttttgaataaagtaaaaaatatcgtagaactgcgttaaagttttgaggtgctagaattttattctagaactaaggtggtatcgcgttgaaattggcgtccttagataaggatgcttttttatatttaaggaggaaaaattatgccgttcgatcacacaaaaatagagccaaaatggcaaaaatattgggacgaaaacaaaacatttaaaacagattgttatgatgattcaaaacctaaatattattgtatggatatgttcccatatccatctggaaatggtttacatgtaggacatcctgaaggatatactgcaacagatatcgtatcaagaatgaaaagaatgcaaggatataatgtattacatccaatgggatttgattcatttggattacctgctgaacaatttgcaattcaaacaggtcatcatcctgcagaatttacaaagaaaaatattgatgtttttagaaaacaaattaaatcattaggattttcttatgattgggatcgtgaaattgcaacaagtgatcctgaatattataaatggacacaatggatctttacaaaattatatgatcaaggattagcttatattgatgaaattccagttaactggtgtccagaattaaaagccgttcttgcaaatgaagaagttattgatggtaagagtgaacgtggagggtatcctgttattcgtaaaccaatgcgtcaatgggttttaaaaatcactgaatatgcagaaagattattggctgatttagatgacttagattggccagaagctacaaaacaaatgcaacgtaactggattggtaaatctattggggcaaatgttgatttcaaaattgatggaacaaataaagtatttacagtttttacaacacgttgtgatacattatttggggcaacatactgtgttatggcaccagaacatccatatgttgaagaaattacaaccgaagcacaaaaagcagatgttgaatcttataaagaaagttgtgctagtaaatctgacttagaaagaacagaacttaataaagataaaacaggtgtctttactggagcttatgcaatcaatccagtaaatggtaaaaaaatcccaatttggatttctgattatgtacttgcaagttatggtacaggagctatcatggctgttccagcacatgatgatcgtgactatgaatttgctaaaaaattcggtattgaaatcattccagtattagaaggtggaaatatcgaagaagaagcttatacagaagatggtgttcatattaactctgaatggctaaatggtcttggaaaacaagaagctattgataaaatggtagattggttacaagaacatcattgtggacaaaagaaagtatcttataaattaagagattggttattctcaagacaacgttattggggtgaaccaattcctatcgttcatatggaagatggaacaatgcgtacagttccagtagaagaacttccattagaattaccagcaactaaaaacttccaacctcatgatagtggtgaatcgccacttgctaattgtgaagattggttagaagtagaaattgatggacaaaaaggacgtcgtgaaacaaatacaatgcctcaatgggctgggtcatgttggtattatattcgttatattgatccacataatagtgaacaaatttgtgatccaaaattattagataaatggttaccagttgatttatatgtaggtggagcagaacatgcggtattacacttattatattctcgtttctggcataaagttctttatgattgtggtgttgttaaatgtaaagaaccatggcaacgtttagtacaccaaggtatgattttaggagataacaacgaaaaaatgtctaaatcaagaggtaacgttgttaaccctgatgatatcgttgctagtcatggtgcagattcacttcgtttatacgaaatgttcatgggaccacttgaagcatcacttccttggtcaacaaatggattagatggttctcgtaaatggttagaccgtgtttatcgtttaatgattgaaactagtaaattatctgatgaaaatgatcatagtttagatcgtgtatatcatcaaacagttaaaaaagttactgatgattttgaaaaattaggtttcaatacagctatttcacaaatgatgattttcattaatgaatgttataaagctgaacatgtttataaagaatatgctgaaaactttattaaaatgctttcatgtattgcacctcatatttgtgaagaaatgtggcaacaattaggacacaatgattcaattgcttatgaaccatggccaacatatgatgaaaaaatgttagttagtgatactgttcaaatgggtatccaagttaatggtaaattaagagctaaaattgaagttgctaaagatgcagatgatgaaactgttaaagaattagcattccaacaagaaaacgttaaagcacatactgacagtaaagatatcgttaaagtaattgtggttaaaaataaaattgtaaacattgtcgttaaataaaatattacaaatatttaagtagagatacgtctcaaaaaccttgaaaaatcaagttttttgaaaaagtgtctctacttttttgtgaatatatgtattttttgggtgacaaataaaataaaatctttatgagaatgtcatgaaataatggttaaagctaggaaattgttaaatttttattgattaaactaacaataggtagtaatataactaacataaggaagcggatagatatggagaggaaagaagaaattattcaggcgacacttatgttagcgtctaaaaatggaatagacaatgtttcaatgtcacaaatagcgacgcaattagggataaagaaaccatcattgtataatcatttccgttcgaaggatgaaattgtaaaggcaatgtatgattatttaagaacacaagcaaaagaaaaactaaaaataacggatcttgattatggaaaacttgtcaaagataaaagtctagaagaagttttaaaattaatggttcataattattgtaagatgagtacacaaagtgaaatgttttcgttttataaaatcatttattccacacgcactacaaatgttgtggctgctcaaattatgtgtgaggaaacagaaaaaatgattttagcaacaaaaaatcttttttatgcattacaagttcatcaaaaaatatttgtaaaagacattgatcaggcagctatctcttttacaatgacaatacattctttgattgattatcaattagataggaaaagtgcaggaaataaatttaacgaggatatattagataattatatttgttggtttagtaaggaatttggtggtaaagatgaaaagaacattgattaattatttaggaattttggggattatatctttgatttcttacacgctggcggttgtcaaaaccaacaacaaagaacaacgtatcatgaaagatacagatcatgataaaataagtataagaaatgagacatttgtgagacaaatttgagacaaacttgagacaaatattaagtacatacatgttataatctacttgtaataaatctagatgacgttacttcaactcaatagaaagtaggtaatgtgtatgatacccatcaataaggtaacctctgatagtgcatgtcggacattcttaagtaatgatgtcagttttgcatcttttattaatgcagttgtatttgaaggagaacaactcattcatcctgagaatcttgtgcgttatgaaaatgatacagcttttattatcaatgattcaaaaagaatagaggataaaaaaagaagaagagatattgttgttaaaagtgatattaatggaatctactgtatactaggagtagaacatcaaagtagtgttgatcaagcaatggtggttagatgtgccatctatgaaatgttggaatatttaaaacagttagaaaataaagagtataaaagattagtaccacaaatcatggttgccttttatacaggaccaaagaaatggaatgtacctgtaaaactcagtgattattttgaaatactagaagaattaaagaaatactttaatgattggaaaatcatcttagtagatgttaaagaaatggatacaagtaagatcaaagatgaacaaacacgctattttatagaagccattcaagcaatgtataagggagactatataaaattacatcaaaaaagaaagatgaataccaataatttgatttatgcagcgataattacagggagtttggatatgattaaagatattgtagaaggagatgagatggatatgtgcgaaggaatggaaagaatggcagaaggatttagaagtgaaggacgtgaagaaggtattcttgttggaagaaatgaaggtaaattagaagaaaaacaaaatactttattaatgcaattaagatgtaagttaggagatttatcaaaagaaacagaaaatacgataagaagtagtacgatggaaaaactaaataagcttacagtatctatttttgatatacaaagtgaaaatgatgttttaaagttaattcattaaacaaaaaaagaaatcatgaaaagcaatgatttctttttaaatattattttaaaggaactaataattgaattgatttttgtaaattatgtacatcaataggaagatgtgtgccttcttcaccatctatatccattgtaagatcttgatcacaagtaatgtgaatatgttgtccttgaatataatggataaaaggactcttatcgtgtttaccaaaacgataatctttaatgagtgcaattaaatctgtgattgaacatctttttacaatcactaaatctaatttaccatcattgatatctgcaaaaggaataataccatcgaaaccaccaacacgattagtgtttgtaattgcaaacatataagcatcttcttcaaaagattcattatctacagttacatttaaatgaagatttgttgataattgttgaggaagttgtgtcattcctttaaaataataagctaaaggaccaaattttttcttttcttcttttgatacaacaaacgaaatatcagaaaacattcccgctgctgctacattaataaaatattggtcattgattttcccaacatcactagaaataacattgaaatttttaatcatttccacaataccatttactgaacttggaatatttaaataattagcaaaatcattaacagtacctgctgctaaaatacataaaggaatttttttatgactatcaaccattccagaaataacttcatttaaagtaccatcaccaccaacagacatgataaaatcatattgattttcatcacagtcttttgctttataataggcatcatcttttttttctgtataaaatatttcaaaatgttctacaatgttttgtaatgttaattgaccaataatacgatctagtttattttgaataatatgttttccagatgatggatttataataataagacaacgtttcatgttattacctcacttaaatatactatatacattttaaaacaattaaaaaagatatacaatcattgtttcaatgattataataaaatagaataagcaaaggagtttattatggcaaaattttatgcagtaaaagaaggaaaaaaaccaggaatttatatgtcatgggatgaatgtaaagaacaagttaatggttattcaggagcagtttataaatcttttacaagtgaagatgaagcaaaagcatttattggtaaagaagtaaaaaaagtaagtgatgatttaactttacttgcttatgttgatggcagttataatattaaaacaaaagaatatggctatggttgtgttttaattgaagggcaacaagttattcaacaattattaggtaaagggaatattcctgagtattcttcaatgcgtaatgtttcaggagaaattcttgggtgtatgaatgctattgcttatgcaattgatcatcattatgagtctatttgcatttattatgattatgaaggtattgaaaaatgggcgacaggtttatggaaagcaaataaggaacaaactcaaaattatgttaaaacaatcaatgatatgaaaaagaagatagatatttattttcaaaaggttttagcacatagtggggattattataatgaagttgctgatgggctggctaaaaaagcagtgggtataaaaaaataaagcttgaaaattaagctttattttttttagcaataatattaataataatataaacaactagaacaatagcataaatccataagaaatcgcttttgatatattgagcatcaccagaccagcatccaaaccattctccacattttttaacaagaatagcaagtgcataagataatgtaccacatccaataacacttaataagactttcacaattttattaagaatctctttaaataaaataatagagataaaacatacagctgtaacaaatacattaataacaaaatgcatataatttcctcctttagataccttaataaaatagcataaaatcaaggtaaatgcaataaaacgtgaactaatagataaattatgataaaatatttttggaggattttaattatgaaattactaacagtatgtatcccttgttataactcaattatggaaatgcataaagcaattaactcatgtcttttaatgaaagatgaggtagaagttttaattgttgatcgtcattcacatgatgaaactttacaagttgctagagaatatgaagaagcttatccagataccgttaaagttattacaactaaagaagatgttccttttttaaaaacagctttaaaatatagcgaaggactttattttaagatacttcaatgctttgattatttagatcaaccatcacttgtaagtgttgtagaaacaattcgtgattttattcgtattcaagcaaatttagatgtattacttacagattataaatatgtagttcctcaaaaaaaagaaaaaagagtttcatataaaaatatttttccaacagaaactatttttgaatggcataatataaaagcatttcataagcattttcaaatagatttaggatcagttattattaaaacaagtactctaagaaaaataaaaacggatgaagaaaatattttttataatgagttaaccgtttatggaataattccttatattaaatcaatgtattatttaaatgtaccatttcattgttatggatcacatcgaaaaattcatatttctaaatcaaatagctatatagatttaatgaaaagtttatgggatttatatgatgtttattcattaaagagtagaagacaaagaacttatgttattgaatatttatcaaaggtctatgtgcttactgtttatttattattaaaatcaaatcaaaaggaacaaattgaattattaaatgcatatttaggatttaatgatcctaaattatacaaagcacttacaaaacgtgtttatggatttttattaagtagtaataatcaaaaattatatgatatgttaattaaaatatttgaaaaagtatatcaattagaaatagaggaatagaatgaagaagaaattattatttgttatacccttaagtttatttgttttagattatttattgatttattttcaaatcatccaaccattagattggatgatttatcatttagtacaaaatttaagatgtgattttatgacatccttttttaaactttgttcaacattaggaagtacatggttttatgttttattagttgtagtattaatgtttttaaaagataaaaaagaacttttgataggtatccatttattaataggacaaggaataaatagacttattaaatatattattaaaagaccaagacctcctcaaagattacatttagtaaaagaaacgaattatagttttcctagtggacatagtatgtcagcaatgattggttatggattattgattatagaagtttatcaaagttctttaaaatataaaaaacttatcatgacattattagcaatgatgattttattaataggtttaagtagaatttatctaggtgtacattatttttctgatgttataggtggctttttgctgtctttaagctatttattatttatttattataatacctcactttatacatagaatgtgtaaaggaggtttttttattggatattgatatcattagtggtttatatcattatggtttgaccattataaaatatgaacaagattattgtttagtagatttaaagactcaagaagtttatgaaaaaatgagtatttattatataaaaagattattaagaagttggaataagcatcgtaaaaatatagagagtgtgatataatggaaaaaagtttgaggtggtttaaaatgaggacagtaaagaattatgtaggaattattttgtgtgcgtgtgttattatttttatttataaaacatttgatatttcattgttttccaatattttatcagcttttattcctttaatagtaggagcaatacttgcttattttttacaaccattggtttataaatttgaaatgtttttagattcttttaataacgataaattgattaaatacagtcatacaatagcatctatttttgtttttgttgtctttgttttgattattgttattttaatgattgcaatcataccagctttagccaattatattgttaatattgcagataacttaacactctatatcaaaaactttgaaaagacactagaattttatttaggaagtagtcttgctagtgatgtaattattaaaatagatgaaatggttgttaaatatgttaattctattgaggctattgatccaattgcgacacttggcactatttttaaggcaggaagtacaattattacagctgtattaggacttatttttacaccttatgtattaatagaagcaaaaaggttagtaagtatttttgatcgtctttgttcactatttatgtcaaaagaaaaaattgctttaattcatgattatgcagtacgttcacatcaaatatttggacaatttatttatggtaagtttttagactctttaattataggggctattgcctttgtaggacttggaatacttaaacttaagttctttccaattcttgcagttatcattttaattaccaatatgattccttattttggaccatttatcggtgggtttcctgctgttcttgtagccttgatgacaggagatttattccatgctttagcggttttagtttttgtctttgctttacaacaatttgatggtttattcttaggaccaaagattttaggagatgttgttggtatttcaccattttgggttttactttctattaccgtctttggacatttctttggctttattggaatgttccttggagtaccaatgatttgtgtcattcgtatgctttttaatgacatcattgactttcgtaataaaatgaaagaattagatacatagattgtattttaaataaatatttgttaggataatagaggctttgtcctcgtagcatagctggataatgcaatcgcctcctaagcgtagagcagtatctagcctaaatgagctataacgggcagaaaaaagtaccatcccctctcccttttgtaaagctttttttctgtctttttttattttttttaaattattatttatataaaccattttttcattctataatcattacttttttataattgtttaaatgaaagctacatttttcacataattcacatacataatggaagcggaagtaaagattatgcataaattaaaaaaattaattttactaatattatctatttctatagcttcactctatctcatgttttctaactctacagaaatagaagcttcaagtaatgataataattcaataaattacttaaaattaaaaaataaaagtacatccctttctactatttatagtgaaaaatatcaaactcgtatacataatcaaattaataaacaaaagaaattaaataattatacttttcaacatcctttattaataaggaatccatatggaacaaatacaacagctgtttatatgtattttaaaaccacagaagaattacaagcaagttacacaattcattgtaataattacgctgatttttcacaaactttgaattctaatacattaagcggttatacaacagaacatgaatatctcttaattggagcaattcctaatcaaacaaatacgattacagttactctaacaaataaacaaggtaaagttgttgataccttatcatggtcatataatgccccttcattacaaggcggtgatcaatatcttacagtagaatgtgatgattcaaatacatcatccttatctaacggtctttatactgttcttggaaacgaggttactgaagatagtgaagaacaagcttatatgagactttatgataattacggcatcattcgtagtgaaattcctatcgtttcttatagaagtcaccgtattctttttgaaaacaacaccatgtactttagtatttctagtacaaaaatagttggtatggaacaaactggttatgtttctaaaatttatgatacaggaaattataaattacatcatgattatatatttgacacaaatcacaaccttctagttttagccacaaaaaaagaagcacaaacaagcgaagataaaattattatgattgaaagaaattttggaaatatcactgaattagttgatcttattgatttacttcctaattattattcaactacttcattacctgatgatgcagaaaatattgattggatgcatattaattcactggctcttgttgataaaacaagtttaattattagttcaagagaaacatccacaattattaaattagataatatctattcaaatccaacaattgattacatgattggttctgataacttttggcaagagagcggttatgattcactgcttttaaataaaacacgtgatttttcaatgcaagctggtcaacatagtgtcacttatgtagaagataattccctacctcaaagtcaatattatctctatctttataataataacctagctgtaagtacaacacgtcctgattatgattggaaaagtgattcaaattattcaaatacttactataacttaaaaaaaggaacatcttattactataaatatttagtagatgaaaataatcgtactgttgaacttgtaagtagtattcctgttgcttattcaggatatgtaagtagtgttcaagaattagatggaaatgtaattatcgatagtggtatcgcaatgtcttggagtgaatacagtcaggatggaactttattaaaaacatttaaaacgacaggtggtaaattcgtttaccgcgtctttaaatatgattatctagattattggtttcaataattaaaaaggtgtagtttgtgctacgccttttatattccatttttataaagaatatattgtacaagatttaaaaagaatacttgtaactcattcatgcttttatcaaagctttcttgatttatattgtagttaaaataaagatgattatctttaggagcaactcctataaacccaactttaggttttattttcacatctaaatagttagcattttgataaaaaacagatctatttgtacaaaaatcatcatatgtttcatgtaaacttacaataataaccaaatcatcttctttcaagtgaaactgatcaataatttcttcttcacttccaagataaaccggtatctcacaaggatatcctaaatatgtcaacgctttttgacatagtaacaatgcaaacctatttccatcgcctaatataacaattcttttacataccatgatttttttaaaaatttgtgtttgtatgtgaggaaaattatttttaataacctttttcatctttttcatatctacttccgcatgcatatattcttcgtacataacatttttaaaataagaaaacttattaatattaatattttttaaatatctgaccatcgaagtcttagacacacccacttcttctataaatctatttaatgtataatccttaatattaccttttaattccattatttttttactaattaaatattccacactctcttttgaactactattttgtatcatcattatttttcctataatcatattttcattcctttatatataattcatagtatctcgttttaattaaatcaaatagaaataaaaaaacataatgcatttcataataatcattatccgtatccatagaaaagctgaaatcaatatattcactatttatttgagatttactaaaaagtatctttgtattctttgtatctaaaacaacttcttgaaattttgcatcacaacagcctaataatcttcctgttgctgtaaagagaccaataagatcattattttttggtactaaaattttttcattatttactgaacttaacaaaaccgttttatcaaatattttcatatctatttgaaaatcaaataataaatttaaaagtgttggtgatccataagctataaatctttcatgttcatttatttcataacatatgccatctatgtcattcatatcgattggagattttcttaattgatttattactgatagtattttatctttttcaaatttatcatatctttctcttatttgttttattcttactattttttcaaaaataatttcatctttaaaagctgtaaagtttttatagcctatttgatttaaatatgctttaaactttggtttagatacatttaaaatagataacattttttctaatgtatatgttggtacctcattataatgttcaaatataattttggatatatatgtatcaatattatcaaaccctatattattagctgctttcaagacatattctatttttaaatttgttttacccataaatagatctccttgtatagtcatacatatcttaatatatcacaaaaattaatataaataacacacttaaaaaacatttattgataacattaacactttgtaaataacgcatttaaaaaacataaagaaaaagttcaattttattttattaaaaattgaacttttatactaattattttacgccttaatattatctagcagtttttttaatagttgtataagctcctgctgcaagtaacatcatgatagcatatgagcttataactgcgttatctcctgtcttaacactttgagattttttatcagctgttggttgtgatggagtttgtgtaccatcttttttgtcatcagtttttgcagatgtatctgctacattgtaattagcagcccatttccaaatacttgttccatcagcagattctggattattatttaatgtataaatccatgaccaatgattactaaattctactagtgtttttacaccatcttgatcaaaatcttctccgaattgtaacttacctgcttcagttgtatcgtataaagaaattttatatttaccatcttttgtttcagttgtagtgaaatcagaatctaattcttgttcatgtctagattctacaacttcttgtccatcagttaatgctttaaatatacgttttgaacaatcttctgtattaactgttccatctgtagccccttgtactaaccaaatagctgttggagaattttttaatgaagctaattcttcatctgttggtgtttctccaccacgtttagtagcaacatctaaagctggacaattgatcattgcagctttgaataaattaggatatttaattaacatacgagttgtcatatatccaccagcagaacatcctgaaacatatacttttttaggattgattccttttttagcaacaacttcttggatttcattatatgctttttctaataagccatctttttgtgcataataccatgtgtctggtgcttggaaagccataacatgagcatttccaaaaatatcttgagcttcatctgttgcccatgcaactgttcctctattagctaataattgagcaacattattttgagaaccattgtaatctccttcaccatttccatggaaccatacgattaatgaatctgcattcccagcatcataatattgataattaataccattttccactttcacagatgtaaatttaacagcttcttcatctacaactgtattagtacatgaataaacaaaagtatcttctcctaaatcagttccatccattgcacttactttaacaggtgtattttgagtaactgtataattaatgtctgaaggaatatttctagctccagtagataaatatgataatgttccagcagcaccatcattttcatcaaaataaatttcaacttttgttcctttttcttctacacgaacaatagttctatcttgatcataatccccataagctttctcatcagctggtcttttaccttctgtagttgttttggcatgaacagtatatgtatctttatctactcctgatactttaacatttccataatctaataccattttataaattgcttgcccattatcttcgatacgtccataaagttgagcagcaactgtagtagcagccgaaactggtaccatacataacgttgctagtaatgtaaacacagcaacaaacatcgcaaatgcttttttcattattttcatttttctttcctccctttcgcaaatacaatggtaccactttcatttcttgtaagcgattacagttttatcatcctaatatttctttaaaatactcaatatcaaatattattctttagtacttttttatggtacttttgttattcttttttgttatacttgattgcacttttagtattgtacttttataataatgttaattattctttaaagaaaagagtatcttaaaacagatttaaatattgataaagaactcattttgtcaacttattaacaaaaatatttaattataaattactcttatctttaagaggattacaatattatgagggggggacttttttaatgaaaaaaacattatatctaatgagacatggacaaaccttgtttaatttgcaacataaaatacaaggttggtgtgatgcaccacttactcctttaggtattaaacaagcacaaatggctaaagaatattttactaaaaataatattgttcttgatcacgcttatgcttctacttctgaaagagcatcggatactttagaaatcattacagatatgccttatacaagattaaaaggtttaaaagaatggaattttggtgcttttgaaggaaaggatgaatgtttaaatcctaaactaccttatggggatttctttaaacaattcggtggtgaaggtgaacttgaacttagagaacgtatgaataaaacattaactgaaatcatgggtaagaatgatcatcaagttgttttagcagtttctcacggtgcagcttgcgcccaattctatcgtgcatgggaagaacatgcaaaagtaaagaaaacggaaagattttataattgttgtattcaaaaatatgaatatgaaaatggcatctttactcttgttgaaatttttaatcgtaacattacagaataggagagaaatatggattcgacaaaacgtaaatcatttaatgcaaatgttgatttgattcatggaccaatctttaaatcactcatcatctttgcattaccactatttatatcaaatatcttccaacaactttataatactgttgatacaatgattgttggaaactttttaggagacgcttctttagcagccattggatcatgtacctctatttatgacttgcttgtaggttttgccttaggtattggaaatggtcttgctattgttactgcaagaagttttggctctaaagatgaaaaattattgaagaaatcagttgctagttctttagtcattggtattgttgtttcaattggactaacacttattggtttaattttcttacaaccacttcttcatttattaaatacgcctacaaacattattgatgaagcttatagttatattttctttattgttttatttattattgttatgtttgcatataacttatgtgctggattaatgagagctattggtaatagcgtaatgtctcttgttttcttagttatttcatctgttttaaatattattttagatttagtatttattactcaattaaatatgggagttcaaggagctgcagtcgcaactgttatttctcaaggaacttccgttattttgtgtatcatttatatgtttaaaaagacacctttattacttcctaaaaaagaacattttgaagttgataaagatctttataaagaattattaggacaaggtttttcaatgggattcatgagctgtattgtttcagctggttctgttattttacaatatggtattaataatttaggttatttaattattgctggacatacggctgcaagaaaactttacatgttctttaatatgccttttacagcgatggctcttgctatttcaacctttgtttcacaaaacaaaggagcaaatcaaaaagatagaattaaaaaagcacttcgttatgcttatatctatgatattgttggtgctgctattgtaacatgcattatcttattatttggttcttctttagtaaaacttatttcaggttctagtaaagaagttgttttacataatgggacactttatcttacaattgttggacctttctatgccgtgcttggaatattgatgcaaacacgttatgcacttcaaggaattggtcaaaaacttcttcctttaatttcaagtgtgattgaattctttggaaagattatctttgttatcttcttaattccacgttttcaatatatggctgttatcttctgtgaaccggttatctggtgtgtaatgacaattcaacttgtctattctttctatcataatccttatattagaaataatgattaaaaaattggacggtgccaaaacatcgtccttttattatattaaatttcttcaccattagattcacaaacttttttataccaatagaatgaatcctttttacttctagagaaaattcttaaaccgataggatcaatttgccatccccaatcagaacttggaatatatggatttttaatagctgtttctgtattacctgcactcatttctaagccttttgtatcagcagcaacacaacttgatgaataataactaaatgaaataaaatcaacaggatattttttcatgatttttagatcttcatcagtcattttaatattgaatcctttatttttatacatttgtaataaatatttaggatattcaccatgaacttgtgtatcactataacaatagatttgtctcattctttgttgttgttctaaaagatcttctggtttacaagtatatggatagtaagttaatttagtaagcatacatcctactttagcatcaggaatgttttcatgtgtaatttttacagcaagtgcacttgctgtaaattgatgatgcattgcttgatattctacttcttcaaattcttcaggtttaaatcttgattcaattaaaccacctgtcataaatggatgtctaatgattgaatcaatctcattaaatgtaagccataatttaactttatctttatatcttttagtaataacatccacataacgtgtaaagaattcaatggaacgacgatcataccaaccattataatccatacaaaaagcaagaggtggttcataatgagacattgtaactaaaggttgcattccatattttaaacattcatcaaaaacagcatcatagaattttaaaccttcttcattaggttctaattcatcccctctagggaaaatacgagaccaagcaatagacattctataaaccttaaatcccattcctgcaagtaaagcaatatcttctttataatgatgataaaaatcaatcccatgacgttttggatagtaaacttcatcatcagtacttaaagctttttcaatcatttcatcagaaatatcacataacccatgagtatttaataaatctttcatagatttaggatcagtaaataattgtacatcactacaacttactccttttcctccttctttccaaccaccttcatattggttagcggcagtagctccaccccataaaaaaccttctggaaattgtttcatattattgtttctccttatttttttattatcaaattcattatatcgatattatagaatatttgtttgttttttcataatataaaaactaattctacttataagaggtgttgttttctatttaaaatgatatgatttgattaaaggaagtggtcatatggatcttatcaaaataggtaaatatatagcttttaaaagaaaagaacaaggattaacacaaaaacagcttgctgaaaagttaaatatgtctgataaatcagtctctaaatgggaaagaggtatatgtttaccggatgtctctgtttatctagaattatgtaaaatactagatataagtattaatgagtttctggctggcgaagatatacctaaagaaacaattgaacaaaaagcagaagaaaatattattcagattaccaaagataataaaaataaacaaaagtatctaaagaaaattataaaattattaatagttatgcttattgttttcatatttattacaagaatatttatttacaaaaaactaacacaaccacaaaactatatagaaccttatttagaaaaaagcacagaaatgcaaacagcaaatatgctttctaatcatccaggtgatattttgttatttcattataattcaaaaaaagattttgattcattaactatgtatttaacccaatatcaaaaaggtaaaaagatatctgataaagaaatctgtacattttataataatccttcaaaaggaataaataccggaaatattgctttagtagtagatcgagaagcatctactttgaagattatagatgcttttgaagatgggtattatatagctgaaggtatttcatttttagaaaacattagtaactatgatgtttgggattatgataaaattgaagaaaaaacagctattaaatatagtaaaaaacaaatgttagtggcattatcttatggaaaaaatcatgtcacatctcttcctataaaagagttagaaacaaacaaaaagataaagaatgattatacatgtattctttcaattaagtttaagtaaaaacgtcatcacttggatgacgttttaataatcaaatttattctttttcttcataatgataaaaatacttacacaaatcattgctgataaaatagaacctaatgctggtgtaagacccataggaagcaaagtatcagggaaaagcttagaagttatataagctccaggtattcttattaaaacaatagagatgacattatgaataaatgaaatcatagaataaccataagcagtaaagaaaccactaaaacagaaatgaatagaagcaaacatacaatctaaaacatatccttttaaatactgacttccatacataataacgatagcttcacttgtaaataacgaaagaatttccttggaaataaattgacaagtaatcgcaaagaaaattccaaatcctaaagcaatcatcattccataacgtaatgtttggcgagcacgttgatgttgttttgttcctacacattgggcacatatagcagagattgctgaaagcatacttgatggtactaagaataaaaagctaatgattttttctacaacaccaactgctgcggcaatatcaacaccacgcatgtttgcgataatcgtaataataatgaatgatacttgaataagaccatcttgcatagaaataggaaaaccgattttaaagatatctttaataatttttttatgtaatttcaaatggtatctatggatgacaatcaattttcttttaataattgcaagtaaagcaacaattacactaataagttgtgaaatcactgtcccaaatgctgctccaacggcatgcatattgaaataaccaatgaaaataaaatctaacacgatattaaaaaaacaagcaactgccacaaaatacataggacttttagaatcccctaatcctctaaaaatagaactaataatattgtaagcagtaataaaaggaattccaataaaacatatttttaaataaagtgttgtttcttgaattgcttctacaggtgtagacataatagaaacaatcggattaataaagaataataaaatcaaagtaacgatcagagataaaatcataaagataatgattgtatttcctacagtcatccttttttcttcttcttttctttcaccaacataacgaccaatcatgaccgttgaacccattgcaattcctacaagcataacagtaatcatatgcatgacctgacttccaatagaaacccctgataaagaagcggctccattgtattgaccgacaataaataaatcagccatgccatagaatgtttgtaagaaattagcaagtaaaaacggtaatgagaaagtaataatattttttaaggcgctgccttttgttaaatctttttgcataacatcaactccttgctttgtattatataggataaatattaaaagataaaacgaaaaaaaatgcttaatctagcactttttttcatgaatatgttgcaataatagatttaagttctctgatttattttgttttaaataaacaagatctattttttcaagatcagcaaagtatttactaatatcctctaaatagaactgatctctgttttctacttcttttgtaggaaggattgaaaaacctctagatagattaagtaaaagaagttgtttgggaaattctttaacgtattctactttattaaaagttgtatgataaattttataaagttcatctttacataattgatgatagttttgatctgttgcttttgtaatatagggaacagattgcatgaccttttctattgtatgatatttatggatcagttcttttgaacaaacaagagaaacgttttctttagataaggttgttgtttcaattggattatttttgtagaaagagagcatacttggagaaattaacgcatcgagttgatgcgcttttaggccttccatcaattcattttcttcaagataagaataagaaatagaaagatgtgggtatttcttttcaaagctttcaagaatttcaaagtctgtaaaatctgttgttttcatgcctatatgtaaagtattcgtttgttgaatattttgacataaagtttgataagaagcataaatgtttttcattccttcatagaactgttttccttgtttagtaagagttaatgttctatgttctcttataaatagctgtgtttggagttcttgctctaagacagcaatgtatttagacatggttgtttgtccaatatgacaagcgttagctgcttgcgtaaagtttttatattcaacagctttaaagaaataatgtattctatttagatccatattatcacctctttcattataacaaaaaaaaggagcaatgaagctcctttgctcaatatttatttacgtttgaataatgattttaaaccacgagagattacttgaaagaaactaagagaacgaactatattatttggatcaacataatttctaacagctcttaatgtctttttattatctcttgtcgaaaagataaagtttccgttgtttttcgtaacaactgcaaaacgaggaatccattttcctttaaacatgacacttgccatgatttctgttacttcagaccaaggaatttgaatataatcattgacgtttttatcattgtaatattcaaaagcttcatccccgactaacactttaccatagtttgccattcctaaataagaagtagcgttaattgttaaatcgacttttttatttaatgattgtaccatatattccctccataaatattgaactttttaaattacataattccagctaaacgagctaagataccaacgataaataatgcaacgataataacgattggtgaaacttttttctttaataaccagcagcaaagtaatgtaagtaataatgctgcaagtccaggaattaattgatctaagttttgttgtaaagtagtaactttaattttatctaatccattagctccaagggaagcatattgagataaagctgatttaataccttcagctccacctttgatttgactccaatcaatataagcaccttcagattgagtaactctagaaacaacaggagtaaatgaaatacttacccaacgttgaactaaagaaccgataatgaacatacctaaaatagaagcaccttgagtaattttacctaataaaccaccagataaatcttgtgcgatagaagtaccaactttatatccaaattcttgagtataccaaataaatgccatacggataatattccaagcaaagaagaataataatggaccaacaatacttccacctaaagcaagagaagcacctaaagcacctaagattggtcttaaagtgaaccagaatactggatctccaaccccagcaagaggtcccatcataccaactttaaccccttgaatagcttgattattgatttcagcaccattagctctttcttcttctaaggctaatgtaacacccataactggagctgaaacataaggatgtgtattatagaattctagatgtctttttaaagcatctgctctatcttgtggatctttgtataattttttgatagctgggataattgaataacaccaaccaccattttgcatacgttcatagttccatgatccttgaaggaactgatgacgccaagcaactgataaacgatcttttttagttaattgaattttttctgccatatttctttcctccttcaagattaatagtcatttaaaatatcacctaatggatcaccagaaccagtagaaccaccattaccagaaccaccgttttcttttaatcctaagtaaattaaagcaatagcaacacctaaagcacctaaagcgattaatgttaattcgcttaatgcagctaatacgaaaccgatagcaaagaatggccaagtttctttagttgacatcatattaataaccattgcataacctacagcggcaaccattccaccaccaacagtcataccacctgataaccaagcaggcatttgatttaaaacactagttactgcttcagcaggaacgatacatagtgcagcagcaggaactgcgattctgacaccttgtaataagatacctaaaatttgatagatttcaattttacggaaatctcctttttcagcagcaccatccattaagtgaactaatgggatagcgattgtacgacaaatcatagttaagaataaaccagctactgataaaggaattgcaacagcaattgaagtagagatagctgtttgtgtattaacagtaccaccatttaaacctaaaaccatgataattgcagaagcaacagaagctaaagcagcatctggagcaacagcagcaccaacatttgcccatcctaaggcaatcatttgtaaagaaccacctaagataataccttcacttagatgtcctgaaactaaaccaattaaagtacacgctactagtggttgatggaattggaattcatctaaaatcccttccatacctgctaataatgctactaaaataattaacataatagtaattgcagacattaaattttccccctatttcatattttgaagttcagtctttgcttttttaagaagactgtccatattttctttagaatcagcaggtactttacgaacatcgaaagtaacacccatttcttttaatttttctaaagtttcaacatctttttgatccatagcgatggctttattaacaaccactttaccaacagagtgagccatagaaccaatatttaattctttaatatcaactccaccttcaatagctcttaaagcatcttgaggagtttcaaataacaataaagctttagtagcaccaaaacgaggatctttagcgacttcaatcatctttttgactggtacaacatttgctttaacacctggtggtgcagcttgttcaatcatttgtttacgtaatgcatcttgagatactgcatcagatacaacaatgatacgtgttggttgagttgattttgtccaagtagtagctacttgaccatgtaataaacgtgtatcaacacgagctaagacatatttaatatgtccatctccaagaacagttccttcaggaatagcctcagcaggtgctggtttttcagcttttactgcttcttcctttttaggttctaattcttctggacgaatgttaactccgtctctagcaacttcacagatatgagttgcgatttcatgtgcgctgtcagtagacatacgcattgcatatgcttcaataagcattggtaaatttaacccagtaacgatagcccaatgatcttcatgaccgttaagtaataagttagcttgattaaatggagttccactccataaatcaactaagaaaagaacttcgtcttgattttcaaaagtggaaatagcttcttccatttttgctcttaaatcatcaggaccttcacttggttgtaaagtcacagcttttacatctttttgttcaccgaaaatcatagaaccagattgtaaaattccattagcgaattcaccatgacttgcaagaataattcctaccatatttttcctccctctctctaattaacattgaataacaaaaaaagtaggccaactatttaaaagaagatacaatgaacccattgctttcttttaaaatagttaatgcctacttaaagttacacactattgaatattcaatttaattacagtaatatactaacatcaaaaaatgtaagcgtcaatcattttttttacgtttttatgttctttcattattttttgataaaaaaaataatgaaaaagataatatataatataaaacaatcacaatttatcaataaataaaaaaaggggtgatcccctaattttgaaatgcacttgataaaattctttccaaatgtaaagcaagatagccaatttctgattctggtaattctttatgaagtacctttgataaattatcacacatccttattgcttgttcataagcaaaaggaaatttatttttggtaaattcactaatatccatttgcaattgttcattagtatttaaacgaatgattaggaatttaatatgattcattaaacgggcataagaaattgattcaacatcaattttcatatttaaatcggtttgtaatttaataatactttcatgaacaacacgagcagcttccatagattctcctactttattagaagaaattgccgagtgaatatgtaaagtaatgaaacttacttcatcattgttgatttctttattaataaaagatttaataatttcttttgattttaaagcaacttcatattcatcagggaaaagaagtcgtatatcataggtaaatggattactaggcaagatattttcatccatacgtttgatcgtaaaatgaatatgatcagcaagtggaataagaatatcatgattgacttgttcaaatttatttgttgcttctttaatgatttcagctgcaatttcaagataaacaggattgatatagtcaatgactttcttttgtttatctttagcttgatagttcttttgcatcatgtatttcttggcgtgaggtggaatttcaaaatgttcatctatttttttaccaaaaccaattcctttagccataactattatttcattatcatcttctttagctagaatggtattattgtttaatatttttaagacttgatacattatgttcacctctttatttttaaaattgtttctccactttttttatgaccatagttcttttctaaaggtccttggtctttagtgataatcattaaaagacaatcatcgatggcattttctttaatataattcaaatctgcattccataacagatctccttttttaaccttctgattcattttaacaagaagttcaaacccttgtccatttaattttacagtattaataccaaaatgaatcaatatttccacaccattttctaattcaatccctaaagcatgttttgtaggataaatcatagaaatcgttccatcacaaggagcaacaaccaaaccatgtattggtcgaatcatgataccatctcctaataacttatgagcaaagatatcatcgcagcaatcttcaataggtaaaacctcaccatcaacaatatttcctatttctacatccgttgtatgataatcaattgttttttcttcatcataagaagcaggaacattatttaaataatcatcaatctttgtttttaaagaagaagcttttggaccaaagatgatttgaatagcattgccctgtaataaaacagcagctgcccctgcttgttttaaagaaccttcgcttacaagacttggatcttgtaaagaagcacgtaatcgtgtaatacaacaatcaagatcactaaagttatatcttccacctagtcctttaataatcatttgtacttgaggatcaagtaatgattggtcaaaagagtaatccattttctttttattaaaaatcgttaatttattatcatcttctcttcctggtgtttttaaatcaaatttcttaattaaaaaacggaatgaaaaataatataagaagaaatacataactccaccaacaataataaaaacccaatgagttttactattaccttgtaatacaccaaaaacaagaaaatctattaaaccacaagaaaaagtaaacccaatcgtcacctttaaaacatgagctaaaacaaaagctgtacccgctaaaaaaacatcaacgacaaataacataggagccacaaaaataaaagcaaattcaatgggttctgtaattcctgtaagcatactcgtaagggctgctgataaaaaaagacttcttataacttttttagattcatctttagcactgcgatacatcgctaaagctgctcctggtaaaccaaacatcataatcatatattcaccagagaaatacttagttgcttcaacactaaagtgctttaaatttggatcagcaagttgagcaaagaagatattttgggcaccatcaattaaaaccccattgacttccaaagtaccaccaatagcagtttgataaaaaggcatatagaaaacatgatgtaagccaaaaggaacaagggctcttttaacaattccataaacaaaagttcccccatagccactactagcaatccattgtccaaatttaaaaatcccgtcttggaaagtaggccaaatataaaacatcaaaaatcctaccaaaatatagacaatggtagagataataggaataaatctttctccttcaaagaaagataaaaaatcaggtaactgaatttgataaaagcgattatgtaaacaactcacacctaaaccaacaataattcctccaaatacccccatttgtaaggatacttgcccacatacatttgtaagggttccttcaacaacttttttaacaatctcatttcctttaataactccatcaaaaataagcaaactatgaatcgttgaatgcatcacaaaaaaagcaattatagaagataacactgctacttcttttgatttctttgccattcctaaagcaacagaggctgcaaaaatcaaaggcagattatcaaaaattgtttgccctacagacattaataaaatcaatatatgatttaaagttgttcctgtacctaaaatactctctaaaccaagagaagcaatcgttgcttcgttagtaagagaactcccaatacctaaaaacattcccgcaattggtagtacagcaataggtaacataaaactacgtcctattctttgtaaaaccccaaaaattttctttttcattttcttccctttcatttataaaaagtatagaattttatactttaaaaacacaatttttcgcatttagtgtatcataaaataatctatatgtacatttgtatagatgagttagattatagatatctttaatgggtaaggtattgtataatatttatatataactaaattcaagggaggaaaagcatatggaagagaaaagattgttgagtaaagatgaagtctattttttagtatttttttctaatttctttattggatcaatcatattgtctaataggtatcactttgattcaatacgttcattttttatatttgctggagaggatccctttccatttactttgtttttcatagtgttcttttgttgtctttattatctttttaaaattttgataaaaaaatacccactaagaaattttattaagagtaatgatgtttaatatcaaaaagaagagatattatggaagaaattaaacaacttgtatataactatgctaaagcaatacacacacaaaatgaaaaagattttaaagcattatggtcatctaaagaaaatactttgatttcacttacgaatcaatttaatgaaattgatgctatttataatgattttttaataggtggtattcaaagactttatgaatcaattgatttaattatagaaggaatagaaatacatcaaatagatgataataaagcattgcttgataacacaagagcacaaacaagtaaaattgttcctacaacattaataacagcatagattgcagttggtttagctccataaaatgtttcaacaagtgttttacttccaaatttactcataattaaataagttattgcaagcataaaaactaaaacactgatactaataatgacaatttgtagagcagttaatgattgacttgatgaagtcatttcttgattcatttggtcaggttgattgttgttttgttgattttgtcctggggaatcttgttgattattaggtgcttgtccagtagaattttcatttgtttgatcatttaaatcttggttttgtgaatttgattaatcattgctactttggttgttttgagatgaatcttgttgattagactcattattttgactattttctcctttattaggcattgaaggaggtgttcctcctgcttgttgcatcatagatgaagtattatggtttttagcataatacagagttcctgaaatcgaacctaaggaaacgataatacaaattacactgattataacggataatttctttttcatgtctatctcctcttgacacctatatagtacccattctttaacatataagagtgtgagtagtgtgtaaaaatatggtaaactcatatacaattttgagatatgaaaaagatggagttaagcgcttacatgtgttactatatatctaggaggattttttatgggaaaattggataataaagtggcaattattacaggagggaatgccggcgttggtaaagaaattgcgaaactgtttgcgagtgaaggagcaaaagttgttatttcagcaagacgtcaacaagtcttggaagaagcagcaaaagaaattgaagcagcaggaggaactgttttatgtgttcctactgatatttctaaagtggatgatgttaaaaacttagtaagtaaaacagttgaaacttttggtcaattagatattttaattaataatgcaggtgttttagataaaggattaaatgcaattgatcaaattgattatgatgatttaaatagagttattgatattaatcaaaaaggaacaatgtattgtatgtcagaagctttaaaagtgatgaaaagtggagcttctatcgttaatatctcaagtgttgctggtcaatatggagcaggtggtgctgtttatgtatctactaaagcagcaattattggggtaacaaaacatgctgctatgcgttttgctaaagaaaaaattagatgtaatgttatctgtccaggaagtattacaacagatatggcagcaggattaacacctgatacaatggatatgaaaatgatgggcgctatgtcagctcatagtgatttaacacttcaaccttgtagtcctttagatgttgcaaaagtagcacttttcttagcaagtgatgatgcagcaccacttacaggacaagttgttgtaagtgattatggagtagatttataatataaaaaataaagagatttcatttattattgaagcagtcaatattagaaatctctttttcattttcaaaaaaatttaatcattatctaatttaacggatacatacacaaataaaagatatgtttattattataaagataaccataatttaaaggaaagatataaacactgccttgatctataaaacctaaacggcaacattgattattttcaatgatttcttttatttaaatctgtaatttctcgttctgttcgtcgcataactatgctccaaaatgatgttttttaaattgtttgtaataaacaataaataagaatgatgtcgtaaaccaagtaattggataagatataacaactccctttaatgttggatagtgtggtgaaatgaaagtaacccaagctacacgtaaaacacaaattccaagacagactaaaagcattggttttaatgattccccacaccctctcattgtccctgaaaagatttctacacaacagtaagaaaaatagaaaggcattaaaaagagcattaaactttgacattgattaatgatggctggatcagatgaaaagagttttgtaatataacttcccccaaaacataagatcacacttaaagaaactgccattgttaaggcaatcgctaaagcggttcttgctcctttttgaatacgatcataaagatgagcaccatagttttgccctacaaaagttgtaatggcggcaccaatggctgccatagacatccaaaataaagcatcaatctttacatagactgaccatgaagcaatcgtttgtgttccaaaagcattaatatgtgtttgtaagacgatattagcgatactatacattgttgattgaattccagcaggagcaccaattttaacaattttctttaatacaggtaaatgaaatttaatttttgataatgtaagttgataaacatctttagaaaacatcaattgaagtgtgactaaaatagcacatactgtttgggcaataaatgttgcaatcgctgccccagcaatacctttatgtaaaataacaacaaaaacaaagtcaaaaacaacattaacaatactacaaataattaaataataaagaggtcttttactatctcctacagctcttaaaattcctgaaccaatattataaatagctccaggaatcatccctaaaaagtaaagtttcatataaagactggcatcatttaaaatatcatgaggaacacctatcgcatctaaacattgataagaaaagaataaaccaaaaagcatcatgataattccactaacaatagcaagcatatatgaagtatgaaccgcttgatgaatcttacctttattatgagctccataatattgagcaataacaacagaagctccagttgataaaccaacatagaagttaacaactaagtttgtcaaattccctgttgaaccaacagcagcaagagcatttgtcccacaagcttgaccaacaataatggtatcaacggtattatatagttgttgaaaaaagctcccaattaatattggaaaaaagaaaaaaagtaattgtttccaaataactcctttcgtaaaatcttgtgttttattcatagattaccctcctataataaaaaacaccaaaaggtgcatcacttggaataatggtatcacataatttttgacaaaacaaccaaagaaggaacatcaaaaagttaaataaagttcatatttcttctttatgatatagacgaaaggaggaacaagaaattacttaaacaaaactcaatcataaatttctctttttaaaaaaaaataataatagattaaaaaacagattctccccctcccttttgaatctgttttttgttatattccaagttctgattggggatggcaaattgatcctatcggtttaagaatttcttgtgtagatttatatgatcgttatagaaaaccattatttattgtagaaaatggtttaggagctaaagatactgtggaagaagatgggtctattaatgatgattatcgtattgattatttaagagaacatattagacaaatgtataaagctattgaagaagacggtgttgaattaatgggttatacaacttgggcaccaattgatttattatctaactctacaaatcaaatgtctaaacgttatggatttatttatgtagatgttgatgattatggtaatggaacttataaacgctctaaaaagaaatcttatgattggtataaagaagttattgcgactaatggatcttctattttagatgactagttaaggaatcgaaagattccttttttcatacgtattatcttgcgtactatcatacatactttttatattttcttttattgaaaatcatagaaagggactttgtgatataattagctaaaggagattttttatgaaagagaaagtattattttttgatatagatgggacattagtatgctcacaaatgggaatttatgaaatacctttaggtgtaaaacaacaattaaatagattaaagaaacaaggacataaactctttatttgtagtggaagacccaaagccatgttagatgaaaaatggctcgatggaacttttgacggttatattttaaataatggtggttatgtagaaattgatggaaaatctatttatgaaaatagaatggattatgagttatgtttaaagacagcaaatatgttagaagaacttcattgtgattatatgattgcgacagcgaatcatttatacattgatccttcttataaagaactttataacttctttgttcaaaagggacattttgaagatctatttacaataaagtttgatcgtaatgaggtattaaaaagagcgattaaaatagaagcaaatgttacaaataaagatcgtgaaaaaatagaaaagtatattcaaaatgattttggttatgttattaattttgatgaacatggcagtgataatgcttttgaattctattcaccaacgatttcaaaagctacaggtattcaaaaaattcttgattattatcatttaaatcaagatgacacatacgcttttggagatggtgaaaacgatttagaaatgattgaattttgtcgtgtaggggttgctatgggaaatgcctgtgatttattaaaagttaaagcaaatattatttgtaaatcggttgttgatgatggtttagaagatattttaaaaatactatttagtgattaaggagaaatctatgattgtatttcatgaagaaagtaaaacttttcatttgtataataatgaaattagttatgtgtttaaaatcttagaaaataatcaattaggacaactctattatggaaaaagaattcatgatcgtaaagactttgatcatttattagaactctttcctcgtcctatgtcaccttgtagctataaaggggatttaagtttttcattagaacatattaaacaagaatatcctgtttatggttcaggtgatttacgtcatcctgctatcgatattttacaagaaaatgggagtcatattttaaactttgaatatgtaagtcatgaaatcatacaaggaaaaccaaaattaaaagatcttcctgctacctatgtagaaaatgaaaacgaagcccaaactcttatcattaccttatatgatggagtcattgaaacaaagcttcaattaagttatactatttatcaagattttcctgtaattacaagaaatgcttttattgttaatgaggggaaacaaaaattaagacttaatcaaatgatgtctatgtctttagacttacctgatcaagattatgaaatgattgaacttacaggatcatgggcaagagaacgttctattaaaacaagaaaacttacagaaggtattcaaagtatttattctttaagaggatgttcatctcatcaatttaatccttttattgctttaaaaagagaagattgtaaagaaacaagtggtgaggttttaggttttagtttggtttatagtggtaattttttagcccaagtagaagttgataattatcatgtctcacgtgtctctatgggaattcaccctcattgttttgaatatctattagatcatttagattcgtttcaaagtcctgaagttgtgatggtttatagtgatcaaggattgaataagatgtctcaaacctatcatcaactttatcaaaaaagacttgctagagggaagtatcgagatcaagtaagacctattttagtgaataattgggaaggcacttattttgattttaatgaagataagatcgtttcaatggctaaaacagcaaaagaattaggaattgagttatttgtattagatgatggttggtttggtaatagaaataatgatcatcaaggattaggggattggtttcctaatttagataaattgcctcatggaattaatggtttatcaaagagaattcatgatttaggtttaaaatttggattatggtttgaaccagagatggtcaatgaagattctaacttatatagaaatcatcctgaatggatattaaaaactcctcatagaaagagttgtcatggaagaaatcaatatattttagatttttctaatcctgaagttgtcaactatattgcccaggcaatgatgaatgtgattgatgattcctatatttcatatattaaatgggacatgaatcgttgtatgtcagaagtctattcaagcactcatgatgttttatcacaaggaagagtcatgcatgaatatatcctaggtgtttatcatttatacgaagttttaaccaataaataccctgatatactctttgaatcctgtgcaagtggaggagcacgctttgatccaggaatgctttattatgcccctcaatgttggaccagtgatgataccgatgcaatagaaagattaaagattcaatatggaacctctctagtttatcctttatcttctatgggatcacatgtatctaatattcctaatcatcaaacatttagaaaagtgcctttacaaacacgtgctaatgtggcctattttggtacttttggttatgaattagatgttaattatttaagtgatgaagaaaaagaaatcattaaaaaacaaattgtttttatgaaacaatatcgttctttatttcaatttggtactttttatcgtttaaaaagtccatttacatcaaacgaaacagcctggatggttgtctctcatgataaaacacaagcaattgttggttactatcgtactttacaagaagttaatgttggatgtcgtcgtttattattagaaggattagatgaaaataaggtttatcatgtaaatgatttagatttatatggtgatgagttgatgaatgttggtttaattataagtgatggttcaagtggtgagaataaggatggtattggagattattattctaaattatatattttaaaggagaaaaaagaaaatgagtaatgaatggtggaagaaagagatagcttatcaaatttatcctaaaagttttaaggactctaatggagatggaattggtgatttaagagggattattgaaaagcttgattatttaaaggatttaggagtgactttgttatggttatgtcctatttataaatcacctatggatgataatggatatgatatttctgattattatgatattaatcctgaatttggaacaatggctgatttagaagaattgattgaaaaagctaaaaataaaggaattaagattattatggatctcgttatcaatcatagttcagatgaacatgcttggtttcaagaagcactaaaagatccaaatagtccttatcatgactattatatctttaaatcctctaaagatggtaaagaaccaaataactggagatcagtttttggaggttcagtatggcaaaaggtagaaggtagagatgaatattatttccatgctttttctaaaaaacaacctgatttaaattgggaaaatccagctttaagacaagaactttataaaatgattaactggtggttagataaaggaattgcgggatttagagttgatgcaattaactttattaaaaaagatcaaagatttttagatggtcctgttgatggacaagatggtttaagtgcttgttttgcttattctagaaatcaaccaggaattgaagtcttttttgatgaattaaagaaagaaacatttgaaaaacataattgtatgactgttgcagaagcagtaggggttcaatataaggatttaggtatttttattggtaaagatggatgtttttcaatgatgtttgattttaattattgtaattttgatattagtgaagatgaagaatggtttaaaagaaatgattggactgttaaacaatttaaagaattattgtttacaagccaaagagaagtacaaaaacttggatggattgctagtttcttggaaaatcatgatcaacctagagcaatcgataaatttgtgttagataagaaaaaccataattattattctcaaacaatgcttgctggtatgttctttaatttaagaggaacaccatttatctatcaaggtgaagaaattggtatggaaaactttgaaagagaaagcattgatgaatttgatgatattggaagtcatggacaatatcaaagagctttagaagaaggctttactaaagaagaagcgatgcatttccttaaccttagaagtagagataataccagaacaccaatgcaatgggatagtagtgaatatgctggattcagtaatcacaaaccttggttaaaaatgacaggaagccaagataaaatcaatgttgaaaatcaattcaacgatccaaattcaatctatagcttctataaaaaaatgatttctattagaaaacaagaagatattcttgtttatggagattttgaagaagtaaatactgtagatgatgttattggttataaacgtacttatcaaggacaagaaattatttgtttatgtaactttacaaacactgaacaaccaattcctgatattcaaggaaacattttgttagataactacaacaattacaacccaacaactttaaaaccttatcaatttattatgattaaaaaataataacagccctttagtgataaactagagggcttttattgtaaaaaaaatagaaccatgtattactacacggtccttacaaaatatatttatatatttttttatgcaatttcattttagtcaactggataccaattgtcaatgaaaatgagatttcgtatctttactttttatctaatctagattagataaaatcatggactatttgtccattgtattaatgaccacgaattttataatagactacaagaagcataattaatgaaacaactataaaagaagaattagaagaagatttacaactcgataaatcaacaataaattgcgaatttattacttctaaaattcaagaaaaatattcagttagccataatgagaatagaatttataatcatagtctctactatataacaatatctaaattacctaataatatgaaaatgataattttgttataaaaaatagacattattattggatgacaatggaagaaatattagcttattctaatattagagaaaagaatttagaagtcgtttattttgttaaagaatttatttcatagataaatttgaaaaagcctaccattcctttaaagtgagatagtaggtctttttttgtaattaattattataatgtatttattttaagcttttatatttacgctgaaaatgaatatttggtctttaaatcattacagcgattataatttataaatccttccttttgtagacgtccaacaacaattccacaaagaacattttgcttttgagcaaaagtaattatagaagcttttgtaaaatcatttttagaagtaaaagcattaaattctgcagtaggaattaatacttcttttgcaaaattatcagcggcttcttcatcttcttcaattgttccatttgattggttgatatgaccaagtaaaatatgaccaagctcatgaaataaactaaaccagaatttgtcagcatctttaccacgaacagttaaaccaacaacaattttatttttatcataaaaagttgctccatgtaagaaagaacctccaatatgaggaagaaaaacaagcgcaattccacagtcagcaaacatatctatcaatttaggacaaaaatcaacaggatccattgttgtcatacttctaatttctggtaattttcttttaagcatttttaaatcaattaatgaagtctcaatagtacgagaattaagctttgctttttgtgcccatgctaataaagcaagattacttttttctgtttcagcaagtctacgacaagcaattttagataattgcatattcttaataataccaagattcacaacttcaaagtactttcttaaattattaaccctttgaattgcatctttagtatcaggaacccacccattctttgccatttcattataaggcaactttttaacaagttctttatcatcatccatttcattttcagcttttgcttttacaatcttttcacgataagttgcttctaaattattccaaaacttggcaggaacacctaacaccatttctaaacgaacagcaacatctggagttaattgaacttccccattgattaatttactaatgtgtttttctgtcatatccattcgtaatgcaaattctttttgtgtaagacctctatcaagtaattgttctttaattgttgcacctggtggtgttgcaataaaactgcgactttttaccatcgtaatccctccttaattacaatgaaaatctaatgataatctacaatttccattacatttgcaatttgaatttcattacctaccttttcaaaaactaatcggtagggatgtactaaatccatcgcatattggccttttcgattcccttttaacgggtgacatcttccaatatggaattgaaccatttcttctacagtatcggatgcatctatttcatctatacgctgatggattttttcagccatttctaagccgtatttcttttctgcctcgattgcgattgtacacaccttttcaatcttacgagtcttatatgttattttcaacatatcgcctctttcgtgagtttacctttgaggtaaatatattatacaattatatatatcttgcgtcaataaataaaatttacctattaggtaatattttacttaaattgaattgataacacaaattataaacaaatgtattatatttttcaaaagttaataatgaatcatttgaagcaaagtttattacttttttaatttctataaaatattccttcattaatatatacgccatttatttctatttttcttttttatttttcatttttttacatgtttggcaattttattatcgttatcggcaaaaataagtacattttataaatgattaagccattatttattgccgataatatgctatactgtattaaacaattatcttaggaggcatctatcataaaactcaaattgatttaacttataattcaaatcatattgaaggtagtcgattgactcatgatcaaacacgttatatttttgaaataaataccataggtatagggaatgaagttattaatgttgatgatattattgaaacaacaaatcattttctttgtattgatttaattatagataaagcaaaaatagaattatctgaaagatttattaaagaattacatttcatcttaaaaaatggaacaagtgattctagaaaagattggtttgctgtaggagattataaaaaactaccaaatgaagtcggaaatatgaaaacacctcttcctgaagaagttgatcatttaatgaaagaattattattagaatataacataaaacaaaagaaaacttttgaagacatcttagatttccatgtacagtttgaaagaattcatccttttcaagatggtaatggaagaattggaagattaattatgtttaaagaatgcttaaaatataatattgttccatttatcatagaagataatttaaagatgttttattatcgtggtttaaaagaatggaataatgaaaaaggatatttaatagatacttgtttaactgcacaagatagatataaagcttacttagattattttagaattaagtattaaaacagaggaatgatgtaaagcatatcgttcctttttgtttacactttttatctaatctagattagataaatcatgattagataaaattgtggactatttgtccattgttttaataattgccgagtttataataaacagtacgaggaaaaataaaaaaaataattttgttataaatagtaacactactattggatgatatgctatttttagttggaagcaaatacatttgcaattttggcgtcaatatattgacgccataggacacaaatgttataattaaatacaatatttattagaaggaaaataggtatatggaatgtacagaattcaaaaaatggctaattcaaaaaaataaatatacagatgcttcaataaaggatattgtttcaagattacgaagagcagacagtattttgactttccgtaatgaagatatttatttgtttagattgaatcaatgtgaagaatttcaaaaagcttctgtatctgttaagtctcaaattaggcgatcggttagattatattttcaatatttagaagaaacggagaatacatagtaatgaaagtcttatctttatttgcaaatataggagtagcagaagcataccttagagaattaggaatagaagtttctgtagctaatgaattagttgaaagacgtgcaaaattatattctgagatatatcctgagacagagatgatttctggaaatattactaatgaaaaaatatttaatcatgtcatagaatcagcaaaaaataaaaaagtagattgcataatggcaacaccaccatgtcaaggtatgagtactgctggtcaacagaatgaagaagatgaaagaaataaattgattatgccagttatggatgccattcgtattttaaagcctaactatgtgtttattgagaacgttcctaaatttttgaatacatctatagaagtgaatgggaataacattttaataccaaaatatattgaaaatgaattgggaaatgaatatgagatacatagttatactataaatacaaaaaactattctgttccacaagtaagggaaagagcaatatttttaattacaaaaaaaggattgagcaatatctggatgttgcctaaagctgacgataaaataataacaatgaaagatgcaattggaaatattccgtctatagatccgtatataaaagatattagcaaaaaagaaatgaaagaaatgtttccggaatatgaagaaaagaaagaacgtgcccttgaaatatctaagtggaatattccaccgcatcatataaaaaggcaggttgtttcgatgatgcatactccaacaggaaagacagcttttgataacgaaaagtatttccctatcaaagaaaatggaactcctgttaaaggatacagaaatacatataaacggcaaaattgggatacaccagcatatacagttaccatggataatagaaaaatatcatctcaaaacaatgtacatcctggaagatacttggggaaggataagaatggagatgatgtatattctgatgcaagaacgcttactttatatgaaattatgttagtaatgagcttgccaccggattggcctgtgccagaaaaaacatcggaagcatttttgagacgtataataggagagggaatacctcccttatttgtaaaaaaagtgtttgaaaaacttatagtgaggtaaagataaaatgcgattaaatggattatcgctgttttcaaatgttggaatagcagaagcttatttgaaggatgtagggattgatatagtattggctaatgaaatagatgataaaagagctagattttatcaggaagtatattctgatgcacatatgatatgtggtgatgtgacagatacaatggtaagagacgaaatagtaaaagaagcaaaagaaaaaaatgtggattttattattgcaactccgccatgtcagggtatgagtgaggcgggattaagattagaatttgatccaagaaacaaacttatattttatgcagtggatgttattaagagggttaaaccaaaatttgttttgctagaaaatgttccaaagcaattaacaactaaaattaaatataatggagacgtaatactaataccagaatatataaaaaaggaattgggtgaggattataggtttaataaagaaactttggtaatggcgaaagattatggtgtaccacagttaagagaaagaaatattttccttttagtaaaaaaggaattaaactatatttgggagtttcctgaaaaacaaaaagaaataacattagaagaagctattggaaatttaccttcactggatccgttgttacgggagggaatagatgaaacacttaaaagatttccggagtatgaagagaaaaagaaaataggcttgcaaatatcaaaatggcactatccgcctaagcattcttggaaacaggtcgaatggatgatgcataccccaactggaaaatcagctatatataatgaagtatattatcctcaaaaagcagatgggacacctgtaaaagcacatcataataattatcgaagattaaagtggaatatgccatgtagaacggttacacagaataatggagttatttcttcgttggcatgtgtgcatcctggaaggaaatatgtttcagaaaatggtgaggtcttgtattctgatccaagagtattgagtatttatgaacttatgattgttatgtcgttgccattaaattggaatataccagagtgggcagacgaaacatttataagacgtgtatttggtgagggaattccttcaaaattggtaaaagaaatagttggagaattaacacgacaattataaggagaagatatagatgggaaaaattgtaataccaaaacatagtgcagatgttgaagaaatgaatgcagtattgaaaatacattatgacgcaaatgattgggttaaatcaagagaatatgtggaaaaattaaaaacaatgataaacccaaatttatatccttcatcatatcctaaaaaagcgcaggtgcctacatattttggttttcttgaatgtaaaattacgagtggtaataatattactgaaagacgaattacaaattcaggaaagaaaatgtatgaggctattatttcagatgacatagcagcgaaacaggagctacttatggatgcagtagaaagagtggtatttggcaaagataacggtggaagtcctagtagtgaatctgatattgatgctcctgatttagctataaaatgtattcttgatacaggctattgtaccagtcatgaatatgcatatatgatttggaatttacatgataatggtaaaaaatattatagaagtctgcctgaaatattaaaagcaagaagtgcaggtggaattgtattatcatcagaagctaaaaactatgcagattggaaaccaatattagccttaataaggtggggatttttgaaaaaagcggatgatggaagacaaaaagttatgattcatccagatgtgtatcaacgttatcgtgataggctagaaaatataaaaatatataacatagataagagagagaaaattgaaataccagaaggaaagaaaattgattcggtagataaaactgtgtttaagccgtttgcaatatcagacgaaaatgcagtgatgataaagaccggagaagtacaagaagatatcgttagtgttgaaaaacaacatatttatcaaggtgatagcgtcttacttgttaatagaactattagcagactattagcatatcatagttattttattgataagatggataaaaatggaacaaaatatcagatatctcttcaaatggaagaagcggtaaataggaaacaagaaaatgctttattaacggatttgagagaagatgctaaaaatcaaagtgaaagtgaataccaaggactattattagatatattaaaatacagtaagagtatgcagaatataaaaaacgtatctgacaaaaatttggatatagaacctgtcaatctagtaattagaactttgtcagagttggaatatttatgtgaaaatgagcttaaatatttattggcagaaactatattaggagatctcaattattcggatgccttaactaaaatcaaagaaggaagaatggctggaacagatatatcaagcaatagagaagcggaacttaattacaaagttatccattcattggtaaatggtaggcttttagaatgggcagaattaaatggtaaaagaattttaaagatagattcaaatctggatgacaaatatttggaacaatttaaacgactgatgatatatgctgtagatatatataaagacgataaaaaaactgcagaagaaagcctaccattatctataaaatcggtaattatcaatgatgccataatggataaggaaattaaagaatgggaaattgatacttcatataattataaaattgcacagggagattatattatatttgtaaaaccagaatttaaaagcattgcaaattatattgtatatcaagttgtttctgtaaataaattaggttcaaatttgaggattgaaattgtgaaacataattatataaacaaagaaaaagagaacgatatactaaaagatttaaaggaggcatactatggcaaatgtgaataagattgaacagtacaataaaggtacggtatttccggatagttataaggaaacttacttagccactaagcatataagcaatataaaaataaatattcctgatgatctattccataaatttaaagataaaatagatgaaaagggattgtattttggagatgattctgttctccgtaatattatagcaggaatcattaaaggaaatataattttacaaggacctcctggaacaggaaaaacaacattagcaaaaataatatgtgatgtttttgatgtttcgtatacggaagcaactacaaactcagactggacaacatatgattctattgggggattacaacctacagcaaatgatgaaggtaaggaggtaattgtaggaaagaatgggtatgtagtatcaagtgtattagaatgttgtgatttaatcattaaaaatgaaacttctgatggagtattgcaaggaaattggttaatattggatgaattaaatagatgtgaaattgataaggtatttggtgatctttttaccgcattagggtcagatgcatctgaaacggaaagagtaatcaacctatggtatcaaaaagatgaaaataaaaaaatgatattcattcctaacagatatagaattattggtgcaatgaataatgtggacaagaattttgtaaatgatatttctcaaggattaagtagaagatttacatttattgatattctaccaccagaggaaaagtattttcagacagaatcacaaaatgcgaaaaagcttgccaaacaaagggttatagataaggttaagacatatggaaaagttacaatagacaataactatatgaatgagttagatggcataagtaatttcaatgaaattgaaattactatgttggaattgattaaaagaattagatattcacatcaagatgatgaatcttatttaggacttcaaattggtacagcacaaatcattgatttatatgaaagcctttatattacaatgattgttgcagatataaaaaataccaataccaacggagaggtaatgaaagatatcgttgactctgttttatctagtagaattattccgcaattagatggatatgattttaataagttagtacagttttttgatgttgtgcaaagcgatagtatattttcatatatgaaaagaaccaaagatgctatatacagattaattcattagaggaaaaatatggaaaataatttatttttagagaaacaaattgaatatatgtattcagatccctctttttttcgatttgtaaatgaatatttctcaacattttctacacaaaatcaaaagttagaaatttggttaaatcatgagaaaatatccgatgcggatatgcatatttatatccggattgtcttagcgaatttaggagatttaagacaaatgatttcagaaagtgaaaaatctttatcttataaatataaagattcaattcaaatatttgatggtgaaattcatggtcatttacaagtgcaaaaatatcttaaatcaaaaacacaaattcgatatcctaaagaatatccttgccaaataaaggtgagaacatctgttacacctgagaatatctttttgatttatattatcgactacgttgttaggctactaaatttgtttacaaagattcttcataattatattggtagtgcttattcaacagagaaatctctgattgatgaatataaaaaagtatttttagcatttgctcgaaaaaaatattttcgggaatgtgcaatgtcattagaaataattaggaaaaagtatggcgaagaatttccaaaaaatgtattaaatgcaataaagatacgagcatcaaagggaaaaattcgaaattatcaagcatatgagaagatatttgaatggtactggaagtataaaaaaggaacagtaacatttgacttgagaaaatatatgaatatattaagatattcatatgatttttgtaatagattgtttgagctatggtgtctatattctatcaaaaaaacatttattgaagattttggaatgactcttataagtgaaagaaacattatgaacaataataaccaaagtgttttttcacttagatcatcaacagatggaattgtagatatattttatcaaaagggtgcaaatttatattgggatgataagacaaaaccagtatggaaatatattgattccgaaggaaaaagaaaaatattatctggaataccagatatatctattaaatatactacttcaacaaatacactggtaatgattgatttgaaaaacagaaatcgttccgcaggaaataattcagaagaaatttataaaatgattggatattttacgaattttgaaaatatgttcaattatgtgtattcttccgaaataaaaaaacaggcaattctaatatatagaaatgattatgcaccatttacagaacaacttgttagcgataataataatttacttaacacttattcagtaagtccatcatcaaaagaaaaattgaattcaaatcaatttaaactaatttgccagtgtatattagatacgcaaggtatagatggaaagacatcagaaatacttggaaattacaagaaagaaaaagaaatactgtcttcaacagctaatgatgaggattctgatagcataatatatcaaataagtgaaaaaaatcatcaaattattagtaagcttttttcttttggagaattagcagaagaacttccaaaacaaatgtattttttaagacaaaattattttcctcatatttgggataatatgtcgcaaaaaacaaaagagatcttagcaatggcagattgcctgttttcgggtatgaaggaatgtaacaatgcagattatgcacctatatgccttgaatattgtagagggttagaagtacaactaaatcagcttgtttttgaaccatttagaaagaatcatgatataactaaattggccaaacaaaatagattttatgaaaaaatgaaggaacaaagagaaatgacattaggcgaatgtgtattttttcttgataagtgtactcataaaagttatccaatgacggagcttaaaagatacatagacaatacagtaagtaatcctaatatattttttgcaaatgtcgttccgatattgagaaaaataaatacagatattcgtcgattatcagcacatacaacgataatgacatatgatgaattggttaatacacgtcagagaattttaggaatcggatacataaatctattctatcaacttttagatcatagataattttatgatgccatatgtaatagtgataaactacggatggatataataaggataagacagaggccatgaaacggataaataactcttatgatttatatttttgtggatgtaaataactacgctaaaaaaagagaaaaaagaataataataatgtaattgactgtgtcaattacattactcgctatactacttctaaacctcctatgattgatgacaaaaatgatcaaatggtggtataactactatgcctttttgtccttgtataagctttttattatttttttctgacgcatccaaattcttagtaaaaaataaaaaacctgcatcttgtgcaggtttttcaatattatatattatttaaataatttagagaaatagtttttaacaacgtgatttttaatttttgataatgttgtgttacttgaatcaaatctgtcttttttagcccaacctggttgagaatctgcttgattagttgttaaatatgaatagtaatttacacacatgattttgttcctccttaatattttgtatcccttttgttacttatattatatgtaagaaagtttaaaaattatatgtgttgaggttatgagaatattgcatacatttgtgcattatgcacaatggtgaatatagtttaaaactatatctaagtagatattatttgtattattcaaactatgttttgattgataaaataaaaacatagtttgaaaggaatgaatgatatgagtcaattaaatagatatgaatttgtaggaagttttttacgtcctgaaagattaaaagaagctagaaaaaattatgaattaaataatataactaaagaagaacttactaaagtagaagatgaatgtattgtagaacttgtaaataaacttaaagaattaggttatcatactatcacagatggtgaatttagacgttctacgtggcatttagactttatgtggggatttaatggggttgagcataaaaagactatagatggaaatcaaacgtttgatggagaagctgctatgattgatgatacttttatgacaggaaagatttcttgtaaagatcatccttttgtagaacattttaaatttgttaaagcattagaagatgaaaatacagttgctaaacaaacaattccatcacctggtcaattctatgctttctttacaggagctgatttattagataaaacattaggtttctatggtagtgaagaatcttttgctgacgatgttgttaaagcatacaatgaatttgtaaaagaaatctatgcagctggatgccgtcaattacaatttgatgattgtgtatggggtggtatggttaatcctgaacttgctgtaagtttaacaggtagaaaaggggaagcattagaaaaatataaacaacttttattagatttaaataataaagttgtcgcaagtgctccagatgatctaacaattaatactcatgtatgtagaggcaattatcattctacttactttagttcgggagcttatgattgtgttgctgatttactctttggtgaagaaaatgtagatgcgtatttcttagaatatgatgatcatcgttctggtggttttgctccattaaagaaagtatcaggagataagaaagttgttttaggtcttattactacaaagaaacctgatttagaagataaagaacttgttaaaagaagaatttatgaagcaactaaatatattccattagaacgtttatatttaagtcctcaatgtggttttgcttcatgtgaaattggtaataaattaacggaagaacaacaatgggctaaacttaaacttgttaaagaaattgctgaagaagtatgggggtaatcctcatatttgttaatttgtaacaaatactgttcacaaaattagtaataatttatatccacaaataaggatacaaaacaggtaatacgagaacctgtcttgtgtcctttttttgttgaaaaataaaggctgtttacagattattaacaagataggtaagaggtatggagagattattaataggataataaattctactaaaaaaatggataacaggatttataaataaacaaattaatatttaaaaaatgagattgatattttttaaataaatgcatataatatatatgaacaaagatatttgttcgatttaagtgcgttgctactttgagtgcaaacctttaatttaagtgcttcactactttaaatgtgaacctttaatttaagtgcttcgcagcttaaaatgcgaattctttaatttacaggaagattagttttatcttcctgttttgttatacttgggaggataaaaatggatttctatcacatagatgaaaaatatataaaatttcttcaacaatatgaaaaacaaaaaagaggaattacaaaggtaccaaatattaagtattctgatcataataaatttgcctttggagccgtaatgaaaattaatgatatccattattatgtttctgtatcatcattttcaaaaaaacaagaagcaaatattttaataaaagtacctagtgataaaaaagtaattaaaggttctttaagatttaattatatgattccagttcctgaaacgtgtcttaataaattggtgattaaagatatttccgatgagaaatataaaatattacttaataaagagtttagattttgtatagataacgcaaaacgaattcaaaaaaaagcacataaaatatacgaaatggttataaacaatcataaacaaattttaactgataacagttgtgattttaaaattctagaagacggctacagaaagtacatagaaaagaatttaaaataaaatatcttcttgaaattttaatatatttatattttattctataccatttttctgtatattataaatactttaacagttcttataaaaagaaaaggagaataacattgataatatcaatgttttctcctttttacactattttacaatatgcatatgagggtaaggtatttcaataccttcctttttaaattcagtgactaaatctttacgaatatctgccagcatttgaaaaccttgtacattatcttcactagtgattgttgctcttaattgaatactgctatcttttaaatcagaaacaatcacagggactaatggatcctttttatcttttcttccatcaatgaataaaggatgttttacaacaagatcttgaatcactttgattgcttgatctatatcactttcataagaaatatcgatataaagataatttgctttaacatgttcgatttgtgaaatattttcaataattgctttattcataatatcattaggaacaatcatttgtgtcttttctaatgtttcaatgacactatgtctaagtgaaatatcaataacagttcctctaacattatgtcctgttacaacaataaaatcaccaatcttatatggcttataagccataatcatggcaccattaataagattacctgcagcttcttgactggcaagtccaataactacggcaacgattcctccagatgcaagtagggcagtcgcaaatgattttaaaaacttcacttcactacaaataattgctaaaaatattgtaatgagaataatctttttaattcttttttgtaaaacataattatcaggccatttctttttaataaacttatttaaaagtttattaacagctattaaaacaatacctgcaataataatagaaataaccccatttataaccccattaacaaataagttatcaatttgttgaaatactttttccatctatttaccccttatttttataatactttgaaaaaatatataagaatactgattgcattgctcctacaatagaaaccattaaacatccataacaaatccaatataaaatactatttcctgtattaattgcatttaatataaagaaaacaataaacgcaattaatgctacattccttgtatacttaaaaaaacgataaaatctttgtgctaatatttcatttgtattcatcttatttaccgatgcaaaagcgtttaaagagttcatctaataaatcctcttttgcttgttctcctaatatttcttttaaacaagaccaactatcataaagatcttctacaattaaatcagcaggaatagacatcttcatagcatcaatagcactttgtaaagaaacagctgctttttctaataattgtgtttgtcttgcatttgtaagatagtattcttcttgattagaaatcaatcctagattaaatttctttttaatttcttttgtaagagctaaaatatcttgttcttttgctgatatttcaattccttctaaatctactttcttacctaaatcagctttattaataataacaatgcgattggtatcttcagtaagttctaatagtttttgatcttctttatctaattccttacttccatcaattactaataatacaagatctgcttttttaatcatttcctttgatttttcaaccccaaggctttctacaatattatctgtttcacgaatacctgcggtatcaatcatatttaataaaataccatctactgtcactgatccttcaacgacatctcttgttgttcctgcaatatttgtgacaatcgctttttcttcttttaacatggcatttaataaacttgatttaccaacatttggtttaccaatgatcgctgtttgaataccatcttttaataatttaatatttttagaatcttctatgatcttattcatcttttcaattaaagaagtagacattggtaataacttatcagctgttaattcttctacatcttcatattcaggataatcaatatttacttctatttgcgtaataatttgaatcaaatcttcttttaaatctttaataaaatgactaatacttccttgaataccttttaaagcaagagaagaagcgtaactatttttagccgtaataatatcactaatagcttctgcttgagataaatcaatacgtccatttaaaaatgctcttttactaaattctcctctttcagcaagtcttgccccatgatgtaaacaaatatctacaactctatttgtaatataaacaccaccatgacagttaatttcaaccatttcttctccagtaaaagttctttttccacgatagatatttactaatacttcatctattttttcaccattatcttttatataaccataagtaatggtatgactctctttatttaatatttttcctgtaaaaaactgttgaacaaatgcaattacatcttttcctgataaacggataattgaaattgctgcttctagtcttgatgttgctactgcaacaataatatcatcattcattttcataccacctttcttcttgatactatcttaatttgttgattttatcaataaataactccctcattataacaaatattttttatttttaacatatgatttttttcgattgatttctattattttatcatatatcattatgtacaaataggggtggaataatgaaaaaactaaataaaaaaattcctataatgattggtgcggttataggtttgatactcgtgatttatatctgtttatgttttctagcatcaggtaatggatttatcaagaatatgacaattaatggcataaaggttaataatatgtctaaagaagaagtcatttctaaacttgaaaataagtatcaaaaagatcaagatcaattattattaaatcttgaaatgaatggtcaaaaatatcaaatagatatgaaagataatgttaaagttaacattaaagatcaagttaatgatattcaaaagaaatataataatttctttactaaaggttatcattatttattaaaacataatgaaaatatttctatagatattaaagatcaaaaaaaacttaataaaaaaattaaaaaatcaggtattttagattattcaactttagtacctactacttataaagttgaaaaaacaaaagtcatctttactaaaggaaaaagtggtaaagctgttaaacaaaaaaatgtttataacacaattgaagaagctttaaatcaatatgattttaataaaacattaaaaatcaatccatcttctgtttcagaagatgaaagtgttatgaaaacaatttataagactttatctaaggaaggtaaaaatgcgactttagataaaaataatgattataaaattgtagctgaacaatatggtgctaaatatgatttagatgattcaattagtgcttttaataaagctaaagaaggaaaagaatttgaagttaaagctaaagctattattcctagtattacaaaagaagatttagaaaagaacttatttaaagatgttttaggtgagtatacaacatcagtaagtggttcttctgtaagaagaaataatgttagacttgctggtgaaaagtgtaatgtgattttacttcctggtgaagaattttcttacaataaaacagtaggaaaaagaactaaagaaaatggttttggtgaagcgggagcatatttaaatggtgaaactgttcaagaagttgggggtggcgtttgtcaaacttcttcaacattatacaatgctgttgttttatctaatttagaagtgactgaaagaacaaatcatacttatatttctagttatgtacctattggtagagatgctactgtttcttggggtggtcctgattttaagtttaaaaataatagagattaccctattaagattgaagcaagttatgctaatagtaaattaacatgtaaaattattggaactaatgttgatggaagttacgtgaagtttacaagtgaaagaacaggggatgttgcttataatactaaatatgaaaatgatgcaactattcctgaaggacaacaagtaactaaacaagctggatcaaatgggggaagagctgtttcttatcgtttggtttatgataaagatggtaaattgctttcaaagaaaaaagaagctaagagttattataaaggtcatgaagcaattattgctgttggtacaatgaaagtggaacaagttccagaaacaacccctgaaacgactccaaatactgaaccaactcaacctgaaacaacgattgaaccctcagaaacgacagcacaataaaaaaacgagcaatgctcgtttttttatacattttcaatgatttctaaaatttgttcgatattcttttttccaaaaacgactttttgatcattaataaccatgcatggtactgacatgatttgatattgatctttaagttgtttaaagtgttgaatatcatagacctccgttgttatttgtttatttaacgaagctattctttgagctgaagtaacgagttctggacacatcgtacaagataaagaaactataatttttatattaatctctttatttattttatctattctttctaaataagtttgttctatcttttgtcctggtcctgcaacattataaattcctagaatgaaagaggtgaattcatgtccaccaggtacaccatggaaagttaagccactccatgtaccatcttctaaacaaatattgacagaaggaatctcttgatttgttttttctatagctatttttattttatcggtttgtaatgctaatgcttccatatatccttttaattcattggataacgtactttcattgagtaataatttaagaataattggattttccatacgtgaaaaaacagcttgtaattgtgaaagcatgtgttcatcaagtaatgaatcgttattaacagttacctgttcttccttttttactggaggaatttttggtattattcccgttttttgatgcattttttcaacatatttttctaatgatgtggctgcttttgcaccatcacttaccgctgtaacgacttgacgcaattctttaatacaaacatcaccagctccatagataccttctttatttgttttttgattttgatcagtaacgatataaccagattcattgagttctacaatatcttttacaagagatgtattcggttgataacccgcaaagacaaaaacaccaaaagtatcattttcatttgcatgatattcaatcacttcatttgtttttttattatgatactttaaagattctaaatacgtatgaccactgacttcaagtacttcaacatttgtataaacagttatcttttcatgattttttgctaacgaagcaatagaagaagcacaactaaagtcatcttctcttattaaaatagtgacatgttttgcatatctggtaagaaaaacactttcttctgcagcagcatagccaccacctacaacaaatatttcttttccttcaaaaaatgaaccatcacacgttgcacagtaggcaataccatgccctttaaattcttcttcaccaataaaacctgcttttcttgggtgagcacctgtcgctataacaataccaaaacacttaaatgttcctcttgtcgtttttacttgtttaaaatccccatcatcttcaatcttttgaacctcagctaacacaaaatcagctccaaaatcttgagcttgttgtctcatcgattctgtcaattcttttccacttgtttttaaaataccaggataattaacaacatcagatgtaatagtaatttgtccaccaaatgtttctttttcaataacaagaacacgattatttgctcttgctaaataaagagctgcagttaaacctgcaggccctccacctataacaatggcatcataaattgtttgttccataaactataattgtcctacaagatctaaacttggttttaatgtttctttacctggttcccattttgctggacatacttcatctccatgagtataaacaaattggcaagcttgcacttttctcaataattcgtctgcattacgaccaacattaccagcattgacttcataagccacaattttaccttcaggattaacaacaaatgtacctctttcagctaaaccgtcttcttcaattaatacttcaaaatcttttgataaggcatgagtaggatctgctaacatagggtattcaattttagaaatacgttttgaactatcatgccatgctttatgaacaaaatgagtatcagtagatactgaatagatttcacaatctacttttttaaattcttcatatttgtttgataaatcttctaattcagtagggcaaacaaacgtaaaatctgctggataaaagaaaaatacactccattttcctaaaatatcttcttttttaactgttttaaattcatcattttgaaatgcttgaacttcaaaatcatttacttctttattaattaatgacatataatctcctccttagttagctcttgctaacttatgtgtttatcatatcgctaaaaattagaatcgtcaatataaatagtaataattattgttattatttattaatacatatatattatgtccatttattgcaaaaataaaagagactgtaacgaaataattttttaagaagttaatttcgtttcgtttggcttctttttctttgtttttcgtataaaaaaacatcttcagctattttagcgagatgtaacctgatttttatatactttttatttatttgaaagtacatactttttagttaagaagaccttttgattgtgttgatttttctttcttcaatctatatttatgatattttctcaaattataacccaaatatacaacgagaaattccatttttgtatttttcaatcctcttcttgtgaagtctgttcatacgctcaaaggaatcactacatcacttcctttatccttatcatcactgacaacaacttgtggttcattacacttagcggtaaatacctgtggttggtttatctagtgccatgcccggcacactacaaaaaaagacaatgtacatcagtataatactggcaacattgttttttttgctggactatatcaatattttatttcgttacagcctctaaagaagtcccattccttttaaaatataaagccacattgttatagaaaatccactaaagatggttgttaacatcacgactgtgctggtaagtattcctgtatgtcccatgtttttagccattacaaagcatgaaactgtagttgctgatccaagcattacaaggatggctatgagctgttctccttggaaccctaaatagatggcaagtggtagaaacattgcacagaagccaaataatttaatgaatgaggcacataaagcaggttttaaatccccaagagcttctttataattaaaagttgctcccattgccataagtcctagaggtgtcgctacatttccaatcgaagtcacggtcttatctaacatcgttggcattggtaaatgaagtaaggaccataaaataccaacaacgataccaataagtattgggtttgttaaaattcctttgattgttttaagccaaacttctttacttaatccttttctttctggtgaaaagaaagaaaggacgacaacggccataatattatataaagggacactcccaataatcattaaaggcgccatggttgcttttccatagacgttttgaatcaaggcaataccaagtaatgcagcagaactacgataacttgcttgaataaattccccttgattttgtttattctttaataaaaaagaaagtaaagtaacaattaaaatacttaaaattgtaataaaaaaacaaaatagaacaaacttcgtatcccaaattgtcttaaaatctaaagttgctagatctttaaataataagacaggtaggggaattaaaaaaacaaacttattcattctagaagcaaaaacgtcatcaataatatctatcttcttaaaaaacattcctaatatgatcatcgcaaaaacaggcacggtcgcatttaaactaaaaattaaattttccattatttcctccctaaagaaaaaaccgcattcgcggcttaatctacatatgagattgtcatatatctattttttccttcgcctttagattcagtctttaaatgatccatctttgcaatttcttgatgcatcacttttctttcatctgcaggcataggatccaattttaaatcagcttttgttcttaaaactgttttaccaaaacgtcttgccatacttgcaacttttttataacgttcttctttataaccattgatatcaacacttacttctaaacgttttttaaatgttgtactgacagcatttttcacaattaagttaatagctcttaaaataactccagctttaccaatcaaaatagaattattacttgtattaatattacaataaattcttccatcttgaacataagaaattgtttcaacttcaaactccatatcagttaaaatctttctaataaagctttcaatatattcttgaaccatttctactgtccaacaagaaatttcagctttcttactaaataaacctttagtttctaaagtaacttcataatttaattgatcaactgtaacacctaaatcaaggcatgctttattaacagcatcttcaactgtttttgcagtatatgttttcatatttatacctctatttattcttattttgtctctttgttaaataatttgtatttgcttgatcaacttctttttgtgctttttcaacatggtaaatataaatataccatgttctaacaattgtaataatgtttgttgtcatccaataaagtgacattgctgcaggcataattgctgcaaagtaaatgataaataatgtcatgaaattattcatcatgttcattgattgcatttgtgatgtttctctatattttggatttcttcttgacatgattgtattgattttcatcgcaaaatattgagttaaagcaacaatggcaagtaatacaatataagctatttcaaacttaaatacgtgatcaataggtttagcacctaagttgattccaaacatatttgtttgatataaaatttcaatacgttgaaccgcttgccacattgcaaacataataggtaatgttaagaatgttgtaaacgaagccaacatactaatatcatttttcttatataaagcttgaatttcagcagacattctcatttgagaagtttgatcttttcttcctttatatttattttgaattctttccatttctggttgaatcaattgcatcttttgttgagaaacagttgatttaatcataattggtaaaataatgatattaattaaaatagtaattaagataacacctaaagcaatattatttaataaaacgtctcctaaataaataatactctttgaaatagggataactaataagaaatcaaaaatccctgatttcatagtccaaggtgtatttaagttaattgctcttttcgcaattaatttaccacttgaatctaagtttgctgtacatccagttaaggctacaacaaataaaactaaacaaataattttaaaatattttttagttttgttatctaagatcatttgctgatctcctttctcttcacttttttatacaagtactctaattcttttttattttctatatatgtatgatttaagaaattttttcttacaattacaatatagtcaacttcttcatcaaaatgaaaacattcttgaatcatcatacgtaactgtctttttattttatttctagtaacagcgtttcctaattttttgcttactgaaataccaacacgtccatgcccaatttgattttcatctttataaataataaaacaagaattcgcaaaactcttttttctagcaataatcttgctaaaatcttcatttctttttactctaaattcttttttcataaaattttagaaaaaaatccaccgaaaaagtggattttacattaagcagttaatacttttcttcctcttttacggcgacgtgcgattacttttcttcctccaacagttgccattctagctctaaaaccatgagtttttgctctttttcttttatttggttgatatgttcttttcatattttacacctccaaaatttttatctttttatacaaataacatatgctcctatatcttataggaattattgtgacaagtcaattctaaattctatatttctactcttaaattcattatttttaatgatgacaaataataagaataacaatatctaatgattatttgcacatttttttgtgaacttttttaatttagaaaaattctctttattgtgaatttaaatttattattcacatcttgtgatatatcgaaatagatagaaaattgtataaaaataataacttttatcaaaaaaagtaacatcactaagcataactcttattaaatgcacattatttgtgaacatttttcaatcaagtacgtacgacaacatgtgaatttctttaaagctcataaaaatacttattcacattttcctccaactccttataaatccttgtttttcccctaaaatcaagtgtgcacttctaagtatttacgtacttttgtatcaatatttatacaatatattcaaaatagtcactaatctaatgtgaataaactctttattttagatattcacatcctaaagtgaatattatttcatcttaacctttattttacaattcttctatttttctaggaaaaatcgcaatttttcttaaaattcacattgtgaatattcattttttgttaaattttatatttcgacaagttttgcacatgcttattcacgtggtgaatcgagttattcatatgtgtgaattagtaaaaaatgcgctgatatcagcgtattttttattgtgaacacctatgtgcacattgttttttattctatacaatatgcactaagttcacatttaataaaattcatagcgaaaaatgaagttgtgaataatgtgaataagtactctaaatgattgatatttcacactttttttgtgaataaaattgtgaagctattgtgcagacagtatttttcctttaaaagagttcacatcttttatataattgagtcgaaagggagttgaaaattgtgcaagatttaaacaaaatctggtcatcttgtgtagaaactttagaaaaaaataaaatagttgatgataagatcatcttggactcactatttaaacctgcaactctagaagaaattgaagataatcaagttattatcaccactgaattaaaatggaatattgatgctattttagaaaaacgagcagaaatagaatctattctttctaattctttttctaaaccaataaaaatcaaagtattagaagtagaagaatataaaaaatctaaacaaaaaaaggttcctaaaatcgatagtcatcttcatcctgatatgacatttgctaattttatcgtaggaaattcaaaccgtatggcacaaaatgctgctttacttgtatcaactaaacctggtatgaactttaatcctttatttttatatagtcatccagggcttggaaaaacacatttattaaatgctattggaaataaagcaaaagaaacaaatcctaatttattagtaagatatattacttctaaggattttgtggatgaaattattaattctataaaaacaaatacaacagatgagatttatagttattatagaaatcttgatattttattaattgatgatattcaatttttatttggaaaagaaaaaagtagtgagatgttcttccatatatttaatgaaatcattaataacaatcatcaaattgttattacaagtgataaaatgcctgatgaacttcaaggaattgaagaacgtttaattagtcgttttaaatcaggtctatcttttggaatagatccacctgaatttgaaacagcaaaggcaattttagagaagaaaatagaaaatctaggtaatacagatttagttattacagatgatgttttagacttcatggttatgaattattgtaatgatattcgttctttagaaggtcaattaaaacgactattcttctgtagtatcatggaatcaactaattacatagatatgaattttgcatctgaagtctttaaagatcaaaaaactataaaaaaagcacaagaaccactaacaaaagaattcattttaaaaacaactgctgaattctattatttaaccattagtcaaattatttctaaaaatagaacgagaaacttggtaacacctcgtgaaatatgtatgtatttaatgagggaacttttggatattacttttagtgaaattggaacaactttttccaatcgagaccattctacagttatgaaagcttgtaaaagagtagaaacaaaaatcaaaaaagatccagattataaactcgctgtagataagcttaaacaaaagttaggcacaatgtagtgactaatatcaacaatatgtgcacattgatattcatataaaaagcattgataaaatcaacatgttttacatttatgcacattgttcacatgctaatagtaataatgatttatttttaaatatataaataacaggaggcaaatatgcattttagaattaaaagaataaaattattaaacgcacttgctaaagcaacaagagctgtatctgttcgtagtcctttacctgttttaacagggattaaatttgatttacaagctcatcaacttatcttaacaggaagtgatagtgatatcactattcaaacaattattgatgaagatgatgatttagtaatccttaaagaaggagcagttgttttaaatagtcgttatatctttgatattgtaagaaagattaatagtgatgatattgaaattgaaattattgatggtttacttactcgtattaaaggaagtcaaattgaatacagcttaaatggtactgatgctattgaatatccacgtattgatttaagtaaaacaggaactcattttataatgaatgctcttgtattaaaagatattattggagaaacaaagtttgctgctagtgataaagaaacaagacctattttaactggtatcaattttaaagcgcatgatcatgttttagaagttgttgctactgatagttatcgtttagctaaaaagattatttctattgatgaagatgtgacttttaatattacgattcctaaattaagtttagatgaaattagtaagattattgaaaaagatgaacttattgaattatatgtatctgaacgtaaagtattatttgtgtttgataaaaatattattcaaacacgtttgattgatggatcttatcctgatacagctcgattgattcctttagaatttgattatgaattagatattaatagagctgatttattaaatgcgattgaccgtgtttcattattattaaatgaacaaaataatattgtgaaattagatatgtctaatgaacaagttattttatcttcatatcaacaagaaattggttcagtagaagaaaatttagcttcttctttctataaaggagaaccacttactatttcatttagttgtaaatatgcaagtgatgctattaaatcatttagtggtgataaaataaaaatattattcactggagaaatgaaaccattcatcgttaaagattttgattctgatgaattattacaacttgttttaccagttagaacatattaagaagcgaaagcttcttttttttgtaaattttccttttaattgtttatttggggagtaatttttattttaagagcttttttatcaaaaaagtatttttctattcgtaaataaaaatagcgaatatagcgcaatattttgaatttttatgattcttatgatatactaacttagtacaattatagagaaaagaaggttaagtatgaaagaaataccaattaaagatgaatatattaaattagatcaatttttaaaatttgttaatcttgtatctagtgggattgaagcaaaaatgattattaaagatggtcaagtaaaggtcaatggtgaagtggaacttagaagaggaaaaaagcttcatgatggtgaccaagttgaatttgaaggaaatttttattgtataaatgcgcatcaataatttagaactgactgattttagaaattataatcatttttttattgagtttgatcaaggaattaatattttaattggtgggaatgctcaagggaaaacgaatattattgaagcaatctatttattatctgtctgtaaatcttttagaacacatatcaatgatcaaatgattcgatttgatcatgactttgcaaaagtaaaaggaaatgttttttctaatgaaagaatgcatcaattagaacttattttatctaaggaatcaaaaaaagcaaaagcagatggaaaagatattttaaagatttcagattatgtaggttatttaaatgcggttgtctttgtaccagatgatttatcattggttaaaggttctccgagtattagaagaaagtttttagatttggagttatctaaaatctcaccaatttatgttttttatcttactaagtataatcgattattaaaggaaagaaatcagtatcttaaattattgaatcaaagaagaggtaaatatgatgaatatctagaaactttagatgagcaattagctgaagttcaaattaagattattgaaaaaagaaataattttatcgaacgtttatctttaaaagtaaaagatatttatttaaatattgcaaattgtcatgagatcgttgaattgcaatatgaatgttttattaaagatgttaataaagaagatattttaaaactttatcaaaaaggatttgaaagagatttaagatatttaagtacttattatggaattcataaggaagatatgaagatctttattgataataagagtgcacatcagtttgcttctcaaggtcaacaaagaacaatcgttttaagtatgaaaatagctttaatagaattaataaaagaagaaattggagaatatcctattcttttattagatgatgttttatcagaattagatgatcaaagaaaaacaaaacttttagatattttaaataatcgtattcaaacgtttattacaacaacatcaatagatggaatagaacatcatgttattaaagaagctaagaaaattaatattaatcatagggaggaaaaatgatggcagaagaaaataaagtacaacatagctatgatgagtcagatatccaagtattagaaggattagaagctgttagaaaaagaccaggtatgtatattggtacaacatcatctagagggttacatcatttggtttgggaaattgttgataactcaatcgatgaagctttagcagggtatgcaagtcatattaaagtaattttgaaagatgacgatgtagttgaagttattgatgatggtcgtggaatgccaactggaaaacacgctaagacaggtaaatcaacagttgaaacaatttttactgttttacatgctggtggtaaatttggtggcggaggctacaaagtttccggtggattgcatggtgtaggtgcttctgttgttaatgccttatcttcatggctagaagtcaatgtttatcgtgatggaaaagaatactatcaaagatttgaaaatggtgggacaccagttgcaccattaaaagaattaggacctactgataagcaaggaacaaaggttacttttaaagcagatgctgaaatctttaaagaaacaacaacttatgattatgaagttttaagacaaagaattagagaacttgctttcttaaataagggattaagaattagtttaactgatttaagagatggacaaaatcgtgaacatgattatatgtatgaaggtggtattaaggaatatgttgcttatatcaacaaaaataaaacaccaattcatgatgaaatcatttatgtagaagatatgcaaaatgatattaagattgaagtttcaatgcaatataatgatggttatcaagaaaatatttactctttctgtaataatattaatacacatgaaggaggaacacatgaagaaggtttccgtttagctcttacaagggttattaataactatgcaagaaaaggaaacttcttaaaagaaaaagatgatgctttatcaggagaagattgtcgtgaaggtttaacagcgattatttctgttaaacatcctgatcctcaatatgaaggacaaacaaaaacaaaattaggaaatgcagaagtaagaaagattgcttcaaatattatttctaaatcattggatcaattcttattagaaaatccagatacagctaaaatcattgtagaaaaagctattgttgcttctcatgcacgtttagctgcgaaaaaagcacgtgaaatgacaagaagaaaaacaggaatggaaattacatcattgcctgggaaattagctgactgctcatcaagagatgctagtgaatgtgaaatcttcattgtcgaaggggattctgccggaggtagtgctaagatgggtagagatcgtcgtattcaagctatcttaccacttcgtggtaaaatcttaaatgttgaaaaagcgcgattagatcgtgttttatcaagtgatacgattcgtagcatgattactgcttttggtacaggaattggtgaagattttgatattaataaattacgttatcataaaatcgttattatgaccgacgccgatgtcgatggaggacatattcgtattttaatgttaactttcttatatcgttatttaaaacctttaattgaaggtggctttgtttatgcggctcaacctccactttatttattaaaacatggaaaagaagaacattatttatatagtgatgaagaattagatgatttaagaacaaagttaggtgaaggtgcaaaatattctatccaaagatataaagggttaggagaaatgaatgcggatcaattatgggaaacaacaatggatcctgaacatcgtattttaaatcgtattgaattagatgaagcgatggaagcagatatgatttttgatgtgttaatgggtgaaaaagttgaacctcgtagagaatttattcaagaaaatgcaaaatatgtaactgatttagatatttagaaggagtagaaaatggataatcaagaaaaaggaattagaaaaattcaattaacatcagaaatgaaaacttctttcatgaattatgccatgtcagttatcgtagcacgtgcattacctgatgtaagagatggaatgaaaccagttcaaagacgtattgtttatggtatgaatgaacttggttgttatagtgataaagcgtataagaaatctgcgcgtatcgttggggaagttatggggaaatatcaccctcatggagattcttcaatttatgaagcattagtgagaatggcacaagatttctcatatcgttatatgcttgtagatggtcatggaaactttggttcaattgacggtgacggcgctgccgctatgcgttatactgaagcgagaatgtctaaaatttcaatggaattaatgagagatatcaataaagatacgattgattttattccaaactatgatggtgaagaaagagaaccatcagtattaccttgtcgtattcctaacttattggtcaatgggacaacaggaatcgctgttgggatggctacaaatatgccacctcataatattggtgaagtgattgatgccgttattgcggtaagtaaaaatcctgatattactgttttagaattaatggaaaattatattcaaggacctgattttcctacaggaggatatattttaggaaagagtgcgattaaaaaagcctatgaaacaggtaatggtttaatcgttatgcgtgcaaaaacagaaattgaagaacataagggaagacaaagaatcgttgcttatgaaattccttatcaagtaaataaagcaagattagtcgaaaagattgcgcatttagcacgtgataaagttgttgaaggtattagtgatgttcgtgatgaatcaaaccgtgaaggaattcgaattgtcattgaattaaagagagatgttcaagcagaagttattttaaatcaattatataaattaacttctttacaaacaacatttggtgtcaataatattgctttagttaataatgaacctaaaactttaacacttaaagaattaattcaatattatttacaacatcaagaagaagttattcgtcgtagaacacaatttgaattaaataaagcagaagcaagagcacatattttagaaggtttaaagaaagccttagatcatatcgatgaaattattcaattaattcgtacaagtagaacaactgaaatcattcaacaaagattaatggatgaatttggaatgtctgataaacaagctaaagctgtaagagaaatgcaattacaacgtttagctggtttggaaagagaaaagattgaagaagaattaaataatttattaattacaattgctgatttaaaagatattcttgctaatgaagaacgtatcttagaaatcattagaaatgaattattagaaatgaaagaaaaatatggtgataaacgtcgtactgaaattattcaaggaacatttgatattgaagatgaagacttaattccagtagaagatgttattatttcacttactaataatggttatgtaaaacgtatgccagtaggtacttataaatctcaaaacagaggtggacgtggtgttaaaggtatgtcaacaacacaagatgatgtgattagttcacttattcatatgtctactcatgatgatttattgatctttactaataaaggtaaggtttatcgtttgaaaggatataatattcctgaatttggtagaacagcaaaaggattaccaattgttaatattttaaatcttgataaagatgaaagtgttaaatcattaattaatattaataagaaaatgattgaagaagataaacattggtatttattctttgcaactgaacaaggtttagttaaacgtgttgatatttcagaatttgaaaacattagacaaacaggtaagattgctattaagttaaaagaagatgatgctttagttggtgttaaattaactaaaggggatgatgaaatcttaattgctgctagtaatggtaaacttgtaagattctctgaaggtcatgttagaccaatgggaagaagtgcaagtggtgtaagaggtattaatgttgatggttctaaagttattggtatgacaacaaaccgagaaggacaattaattatggttgttacggaaaaaggttatggtaagatgtcaccaattgatgaatatcgtgtttctaatcgtggtggaaaaggtgttaaaacaattaatgttactgaacgtaatggacaaattgtagcgattagagcagtagaaggtaatgaagatttattaattattacagatgatggtattgtgattcgtttacctatggaacaagttaaaacagcaggacgtgcgactcaaggtgtaagacttattaaagtacatgatagcaaggtttcttctgtggaagttgttgctaaaaatgaagaagaagttgtagaagaaggtgaagaagagtcagagtaatctgactcttttagaaatgaatggggaagaattaaaaagattgtttaatcgtttagatcattcaaagtttagaagttcttttcatcttgctaaaaagtataaagattattgtaatgaaaaaggcttagatgttatagaacaacacgccagagattttatttctaaaagaatagcaccggctgtgattttaaatgatggaaagcaaacaccgatgaaaaatcatcctgtgtttattgctcaacatgccacggcttcatgttgtcgagggtgtttatataagtggtatcatattaagccacatacacagttaaatgacagtcaacaagagatgattgttcaagtgattatggcttggattaaaagagaattgcaaagaaaatagccttgatgtataatcaaggcagttattaataatataaggggaaagaaaatgattgatattaatttaattagagaaaatcctactttagtcaaagaaaatatgaagaaaaaatttcaagatgaaaaagttggattagtagatgaagcttataaattagataaagattatcgtgaagttgtcacaagagccagtgaaattagaagtttaagaaataaatattctaaagaaattggtgctttaatgagagaaggcaaaagagatgaagctgaagaaattaaagcaaaagtaacttctatggcagaagaattaaaagatttagaagttaaagaagaagaatatggtaaagaattaaaagaaatcatgatgaaaataccaaatatcattcatgattcagtacctattggaaaagatgattcagaaaacgtagaaattcaaaaatacggagatccagttgtacctgagtatgaaattccataccatgctgatatcattgctcgttttaatggtttagataaagaagcttcaggtagaacaagtggaaatggtttctattatttaatgggagatatcgctcgtttatcatcagcaatgctttcatacgctagagatttcatgattgataaaggatttacttattgtattccaccattcatgattcgtagtgatgttgttacaggtgttatgtcatttgatgaaatggatgccatgatgtataaaattgaaggtgaagatttatacttaattggaacttctgaacatagtatgattggtaaatttaaagatcaaatcgttaaagaagaagaattaccaattacaatgacttcttattcaccatgttttagaaaagaagtaggtgcacatggtattgaagaacgtggtatttatcgtgttcatcaatttgaaaaacaagaaatggttgttttatgtaaaccagaagaagctatggaatggtatgacaaaatgtggtcatatacagttgaattatttagaagtttagatattccagtaagaacattagaatgttgttctggagatttagctgatttaaaagttaaatcatgtgatgttgaagcttggtcaccaagacaacaaaaatattttgaagttggttcttgttcaacattaggagatgcacaagctagacgtttaggtattcgtgctaaaggtgaaaatggaaattattatgtttctactttaaataatacagttttagcttcaacaagagcagttattgcttttattgaaaataactataatgaagatggatctattaatattccagaagcgttacgtccttatatgggtggtaaagacattattattcctaaaaaatagtcacttcggtgactcttttttatagaaaggtaaaagaaagatggaattatttataagtgaagcagaaattgaggatgcttcaatgattattgattatttaaatcaggttggtggagaaagtgataacttaacttatggtttaaatgaatgttatttaaatgaatttgaagaaatggaagttattcaagattttattgatcaagagaatagtttacttttatgtggttttattgatgatgaacttgtttctttattatctattcaaggtgaacaaaaagaaagattaaaacatattggtcattttgcaatcactgttaaaaaagaatattggaatatgggtattgcttcaatgatgatggaagaagctttagaaatgatcaaagaaacatctttaaaaattcttgatttagaagtgaaagaggataatttatcagctattaatctttataaaaagtttaattttcaagaaatagggagatatcctcaaatgtttaatgtcaatcaaaagtattatgatgcacttttaatgaatttatatattgattaaaaatctaaaatacgttataatcatatttgccattacaataggcggcttcgaaccatgtcaggaccggaaggtagcagcattaagaagtaccgtctatgtgtgatggtctttatttttagaggaaaaaaagatgaatgatgaagaatatatggaaatagcttatcaagaagctttaaaagcattaaaacatgatgatgtaccaattggatgtatcattgtaaaagatgatcaaattattgcccgtgcatataatcaaagagagtatttaaatcaaacttatggtcatgcagaaatgttagctattgaagaagcttgtaaaaaaataggaagatggcgcttagatgaatgtacactttatacaactttagaaccttgtttaatgtgttcgggagctattattcaaagtcatattcaaagagttgtttatggtgcaagtgatacaagatggatgtctttagataaattgattcatttaccggatcctaaacttaattatattcccatgattcaatcagatattttaaaagataaatgttcaaagttaataaaagactattttaaaaagaaacgtcaaaagatatgattactcatatctttttttcgtgtataatgtaggagataggagttgagaatatgtcatataaagccttgtatcgtacttatcgtccgcaaacatttgaagatgtcgctggacaaagtcatgttacaattacattaaaaaatgcaattaaagaaaatagaatagcgcatgcttatttatttgctggaccacgtggaacagggaaaacaacgattgctaaaatattagctaaagctattaactgtacaggagatcatcctccatgtaatgaatgtcctaactgtaaagcaattactcaaggagatcatcctgatgttattgaaattgatgcagcaagtaataatggagtcaatgaagttagagatttgatagataaagtcaaatacgcccctattaatgctaaatataaagtttatattattgatgaagttcatatgatgacacctgaagcattcaatgctttattaaaaacattagaagaaccaccagcacatatcgtatttattctagcaacaacagaaccacataaaattttgccaactattatttcacgttgtcaaagatttgatttcaaacgtgtggatgaacatgatattattagtcgtttggaatatgtattaaaagaagaaaatgtagaatatgatgaagaatctcttgaaattatttctaagttggctgatgggggaatgagggatgctttaagtattttagaacaatgtttagcgtatgatagacatttaacagtagaaaatattaataaagtttatggcttattagcaaatgatgaaaaaatacgtttaattaaattattactgacaaaggatatgaagaatgttttaaaaacattagatcatatgatgtctttaagtattgatttaaagagattgacacaagatttaatagatgttttaaaagatgttattatttttaaaaacacgcaagatttatctttattatttgttttgcataaaaacgatatccaacaaattgttccttatatattagtagaagaagcatttcaaatgattgatatttttatggatgcaagtagtcattatggacaggctgtagattcatcaacatattttgaattagctttattaaagatatgcaatcaaattgaaaatgaacataaagaagttgttgtagaagaaccaaaagttattgaaaatgtttcacatgaaacattggttgaagttcaacaagaagaagtgattgaaaaaccagtagaaaagatacaagaaccagtaattgaacctcaagaagatttacaagaaaaggtagaagaaaagaaagaaccgaaagttgaacaagtagaaactcctgtggaagaatctaaagaagaggtaaaagaagtaaaaacaacagctcaaatagaagtagactttaatgacattttaaatattttagtacaggcaaaaagaacagttttaaatgatattcaagataaatggccagttattagaagatattgttataatcttaatactgctaaatatgcaaatatgctatgtgatgctaaacctgtagctgctggtgaaaaaggttttattttgacattgaaatatcaaccagaagtgaatagtattaactatacagaaaattattatccattaaaaaatttcttaaaggaagttttaggatcagaatacgattttattgcagtaatggaagcagattggccaaatatgagacaaaaatttattcaacttagtaaagaaaaaaaattaccacaaccacaaccaattgttttacatcatattgatgaatatcatgaaccggttgtagaacttacagaagctcaacaatatgcgattgatatgtttggtgatgagattgttgaatttgaagaataggagtgtattatgaattatccaaagtcatttacagatttagttgaatgttttaaaagactaccaggaataggtggtaaatctgcagaaagattagcttatcatgttttatcaatggataaagaatatgtccaagagtttgcaaatgtgttatctcattttcaagataatatccattactgtaaaaaatgtggacatatttgtgaaggtgaactttgtgaaatttgtaaagatgaaacaagggatcaatcagttatttgtgttgtagaaagtcctaaagatgtttttgctatggaaaaggtaagagaatatcatggattatatcatgttttacacgggacgatttctatgattgatggtaaaacgatagatgatttaaatattaattctttatttgaaagacttgatggagttaaagaagtgattattgcaacgaatcctacaagagaaggtgaaacaacagcattgtttctagctaagttgttagcgaaaaaaggaatagaaacaagtagaattgctaatggattaccaataggaagtaatattgattatgcagatgaattaacattattaaaatctttagaaggaagaaagaaaatataagaccttgcaagaggtcttttcttgtttaaatagaaaaatcagttataataatgaagaaagaggagagaagtattatgacaggaaagtttattacattagaaggaccagaaggtagtggaaaaacaacagtttctaaagaacttgtaaaaatattaaatggatcaggatataaagtcttacttacaagagaaccaggtggggttgatattgctgaacaaataagaaatgttattttagataagaaaaatacaaaaatggatgcacgtacagaagctttattatatgcagcagcaagaagacaacatcttgtagaaaaagtattaccagctttaaaagaagggtatattgtattatgtgatcgttttgtagatagttcacttgcttatcaaggtgttgctagaaatctaggaattgatgaagtttataatatgaatttatttgcgataaacgatgttatgccagataaaactttattttttgatattgattataaaaaaggattagaaagaattgaagttaatcaaagagaaacaaaccgattagatttagaaaaaagtgattttcataaaaatgtttatgaaggttatttaacaatttgtaaacaatatagtgatcgtattgtaaaaatcaatgcagatcaaaaggttgaagatgttgtacaagatgccttaaaggaaattaagaaaatattatgatcaaagattatttaaaagaaaatcaacctttattctatagaattattgaaaatgaatttaacttaagaaaaataccacatgcattcttacttgtcggaaataatactgatcaaccattacagtttctaacaatgtcacttatatgtaatgaaaccttagcttgtgaacaatgtatagattgtcaaaaagtattaaaccatcaatatgcagatattatagaaattgatggagaagaggaaagtattaaaaagaaacacattgaaaatatacaagaaactttcaaaaagtcttctcttgaaggtaaggcaaaagtttatattttaaagaatgttgaaaaaacaaccaaagaagctatgaatgcattacttaaaatattagaagaaccaacagaaggtatttatgcaatttttacaactaaaaatatcaatcgtattttaccaacgattatatctagatgtcaggttatagaattaaaaccagataataaagaagtgcttaaagaaaaattgattgctaaaggatatgaagaagaaaaagcaagtgtcttatcttatattattaaagatgaagatgatttagaaaatataaatcaggataattttgatgatattatgttacaagcaattaattttgttgaggatttatttttatatagagaaaatcttatcataaacacacaaattcatatgcttaaagatcataaagaaaaggaaaatattaaattatttattaatttaattattcttgcacttaaggatatgtttcacgtgaaacaaaatgaaaaagctgttttttgtaatcacgtagaattttttaattcactaacatatgataacaatgatataataaagaaaattgaattattattagaaacatcatacttattagatacaaatgctaatattccattacttatggatagtatgatgtatagaatatagaaaggaatttatatggaagaaattaaacttgcaagtgtaaaatttaaaagtgctggtaagatctattatttttccacaaatttaaaattaaaaaaagatgaccgagtagttgtagaaactgctagaggattagaacttggagaaatatcacaggaattaaaagatatatcagaatttaatttagatacagaattaaaaaagatagttagaaaagctacaaaaaaagatatagaaaattatcaaaaaaatgttaaggatgcaaaacaagcattagtaacatgtaaagaaattgtttcaagatatgatgttaatatgcaacttactaattgtgaatatacattagataaagcaaaagttatttttatgtatacttccgatgatcgtgttgattttagggaactattaaaggaattagctgttgttttcaaatgtagaatagagttaagacaaattggtccaagagataaagcaaaagtaattggtggaattggaacatgtggtttaccattatgttgttcaactcttttaggagaatttaatggagtttctattaatatggctaaaaatcaaatgttagcaattaatatagaaaaaatatcaggtgcatgtggaagattaatgtgttgtttaaaatatgaagatgaaatttattctttagaaaaagaacgttttcctaaaataggatcgcgtgtaaaatatcaagataaagatgtaaaagtaacaggattaaatgttattaatgatcttgttaaaattgaaacaaataatggaattgtattcgttggtttagaagaaattaaatttgataaaaataatcatgcaggaaagaaaaatggaaaaccaagaagtcattaattatttattagcacataatgatttgaaaattatccaaagaaaagatatgtttaacttttctttggatactgttttattatcacagttttgtacaatcaataaagatgtaaaaaatattgttgattttggtacaaataatgcggctattccattattgctttcaaaaagaacacctaaaaaaattataggtatagaaattcaagatgaagcggttgatcttgctagaagaaatgttgagatgaatgatttaaatgaccaaattgaagtcgttcatggagatattaaagatgttatcaaagagttaccaaaagcacagctgattgtttgcaatccaccattttttaaagtaggggaaaatagtaatttaaatgataatgaatatttaacaatagcacgtcatgaaataaaaattgatttagaaggtattatttcagcggcagcttatttattagacaacaaaggaagatttgcaattgttcatcgacctgatcgtatgattgatattttaaatattatgcaaaaatatgatattgaacctaaaagaatacgttttgtatatcctaaaatgaatagagattcacatgtcttattagtagaaggaatgtataaaggaaaaaaaggattaaaaatcgaaccaccattatatgcacataatgatgatggaagttacagtaatgaagtaagaagaatgtttggagagaagatagatgaatagacaaaagagttttgaaaatgaaagaccaacattatatttagtagcaacacctattggtaatttagatgaaatgacatatcgatctattaatactttaaaaaatgtaaaatatattgctgcagaagatacaagaaatactgttaagcttttaaatcattttgaaatttcaacaaaacttatttctcatcatgaacataacataaaacaatcaattcctaaacttatacaattattagaagaaggaaatgatattgctttagtaagtgatgccggttatcctgctatttctgatcctggatatgaattagttaaagaagcaatagaacatgaaataaatgttgttcctatttcaggatgtaatgcttgtttagatgctttagttgtttcaggaattgcaccacaaccatttatgttttatggctttttagatcatttagataagaaaaagaaaaaagaattaattgatttaaaaaaatataaagaaacaattgttttttatgaatcaccacatagaattaaaaaaacattaaatttaatgttagatattctaggagatagaaatattgctttatgtagagaaattactaaaaaacatgaagaaatcattagaggtcatatttctgaaattatttctattgtagaagaattaaaaggagaaatggttattgttgttgaaggtagtcaagaagtagaagaagaaataacttttgaaacaacaatcaaggaagacgtagatatgtacattgaaaaaggaatgtctactaaagatgcaattaaagaagttgctaaacaaagaaatttaaataaaaatagtgtttatcaagaatatcattctaaataatgatattctttttttgtttcacgtgaaacaaaattaaaagctataaaagatatatcatttgtggtatattataaaaaaggaggaagtggtaatatgtatagcaaagatagctacaattatggtagacatgggagaaaaagaagattaaaaccaatatcttttattattacagtattggtgattatattaatattgggaggcctttattttttattattcaatggtaagaataagtatgaagattatacaacatataataccaataataagcaatatggaacagtaaaacattatgaaaaggataatgatcaattttatgtttcattatattatcctaaagtaaaagaaaaaaatttaaataaaattattaaagaatcttatactacatatttaaaatcagaaaaaaagaagaaagatcaaaaagatatactttatttagattattcatgtaaaaaactatataagcagtatattgttattgaattagattataaaagagtaagtgaagacgaaacaaaaataaataacaaaaaatcaattatgacatatgattgtaaaacaaatcaattagttgctttaaaagattgtttacatggtaaatatggtgatttattaaatacattgggtgtaaatgaatataacaaagaatcaacattaataaaagttgataaagatagttttacatattatacagatgatacattaaaaaataaaattgttattaattataaagaatataaagattacataaaattagcaaataaaaatattccatctaatgcaccattagatgtcaaagcacctaagttaatgaaagtagatccaaagaaaaaaatggttgctattacattggatgatggacctcataaaacgttaactgaaagagcaatgaatgcatttgaaaaatataatggtcgaggaacattcttcgaattaggtcaaaacatgaatctttatccagatattgttaaatcagtttatgaaagaggacatgagatagcaagtcatacatatcaacatgcacaacttacaaaattagatgctactgctttagatgaagaaattaagaaaacacaagatgcttgttttaaagcaacaggtactgaaccgacacttgttagacctccatatggagcaaaaaatgatgcagttaaatcagccttcaacacatatggtttaagtatgattttatgggatggagatacagaagattggcgttatagtaaagcaacagatggtgcacaaatagtatgtaataatattataagagatgctaaagcaaaaactggtgatggtaatattgtcttgattcatgatattcatgaaaattctgttgctggattagaaatggctttagatcaattaagtaaagaaggttatcaatttgttactgtatctgatttaatcaaatataaaggacattctgaatataaatagtatagtttaggctatactatttttgtttcacgtgaaacatatttttattcaaacaactcattgacattgatttaagggtttgataaagttaataaggatataataaatacgaagaatggaagatgttaaagcaaaacatttagagagctgatggctggtgaaaatcagtatgttaaactttaagagatggcccaggagtagttatttcaaatagttagaaataatcgttaactgcgttaaagttttgagtgacacagcaatgtgtaaaaaaggtggtaccgcgattattcgtccttttataagggcgttttttatttttataaaggagattagaagatgaaagacgaaaaagattattatcttacaacagcaattacttatacttcaggtaaacctcatattggaaatacttatgaaattattttagctgatgcaattgctcgttttaaaagacaagaagggtacaatgttcgattccaaacaggaacagatgaacatggacaaaaaattgaaattaaagctaaagaagcaggaattgaaccaaagcaatatgtagatcaagttgcaggtgtagttaaaaatatttgggatatgatggatacatcgtatgatcgattcatgagaacaactgatgaatatcatgaaaaacaagtacaaaaaatctttaaaaaattatatgacaaaggtgatatttatttaggtcattatgaaggtaaatattgtacagcatgcgaatcattctttactgaatcacaattagttgatggtaaatgtcctgattgcgggggagatgtacatgatgccaaagaagaagcatacttctttaaattatctaaatatcaagatcgtttaattaaacatatcgaagatcatccagaatttattcaaccagtttcaagaaaaaatgaaatgatgaataacttcttaaaaccaggattacaagatttatgcgtttctagaacatcatttaaatggtctattccagttgattttgatcctaaacatgttgtttatgtatggattgatgccttaacaaactatattacaggacttggatatgatgcagatggaaatcatggtgaattatataaaaaatactggcctgctgatttacatttaattggtaaagatatcgttagatttcatacaatttattggccaattatgttaatggcattagatattccattacctaaacaagtatttggacatccatggttattacaaggtgaaagtaaaatgtccaaatcaaaaggaaatgttatctatgcagatgatttagtagatatctttggtgttgatgcagtaagatatttcgtattacatgaaattccatatgataatgatggaagtattacatgggatttattagtagaaagaattaatagtgatcttgctaacgttttaggaaacttagttaatagaacaattgctatgtctaataaatactttggtggtattgtagaaaacaaaaacgtatgtgaagacgtagatcaagaattaaaagatttagcgttagctatgccagctaaatctattgctaaaatggatgaattcaaagcatcaaatgcattagatgaaatcttcaacttattaagaagaacaaacaaatatattgatgaaacaatgccatgggcattagctaaagatgaaactaaaaaagatcgtttagctacagtattatataacttaattgaagcaatcagattctcagcagttatgctatatccatatatgccttcaacagctacaaaaatcttagatcaaattaatacagatcaacgtgattttgaaagtttaaaagaatttggaaactatgcatcaggaacaaaagtagttgaaaagccagaaatgttatttgctagattagatccaaaagaagttgctaaaaaagtagaagttattgaagcaaaacaaaaagcttctatcaaagctgtaaaagaaaagaaagaaaaagaagctaaagaaacaaaagaagaaattacaattgatgacttctctaaaattcaattaaaagtaggaaaagttattaaatgtgaaaaacatccaaatgctgataaattattagtaagccaaattgatgttggtgaagaaacaccaagacaaatcgtaagtggtattgctgatgtttattcaccagaagaatttactggtaaaaaagttattgttgtaacaaacttaaaaccagctaaattaagaggcgtagaatcacaagggatggttcttgccggtggagataaaaaagtattaggtgttgtagatgcaggagaattaccagtaggtacaacaatcagataatctaaaatcgcatgatttcatgcgatttttttctattctgtctatattttttttatcaattataatataatgtccaagtacaaagtaaaattgaataatatttataggttttaaatattatatatttaaattaaaaaggaatcaggtgaaatacctgaacggtcccgccgccgtaatgtggaggataagcataaagtcactggaaaactgggaagacgcttaaacaaagaaacagagtcggaatacttgcctatatctaaggatacactttacggagtataaagtagttcttctagatgaactaggataactatgcctagtttttatttaggagttatttaatttgaaaggggaaagaatatgaaaatgaaaaaaattgtatgcagtcttatgatttcagtattatgttttatgactgctatttctggtgtatcggcagcttcttatgatacatcaaaaattaatgatgcttattctaaagttgttgaatattataaaaataacaatactttaaataatgcagataaaattcttgctgtagaatctttagggttagaagcagaaagtaatcaatttgatatttcttcagtagattttagtaaaacatcactttctaaaaaaattgtaacagaagttttattaggaattgatcctacagaagacaaagaaacattagaaagccaaattgatgaaaatggtaatgttgaaggtagctggggagcttcttcagatatttggacattatatgctttatatgctacatcatcagaaaaaacaaatttacttgctgataagttaaatacagatttagcatcatctagtgtttgtggttatgaatggggtggagtttactatgctgactatgatactacaggatgggttatcgaaggtttagcagttgttaataaagaaaaatatgccactactattaataaagcaattgattatattaaaaataatacaacaatgacaacaacaggatgggttactgctgataatgtagatactcaatcacaagtattagaaggaatgttcgcctatgatacaaatagtttattaaatgatagctatactattcatccaatagattgtcttttaaataaacaattaagcgatgggtcattcccaagtggttataatgcagaatatacaactgcagaagtagctaaaacattaggtacatataaaaatggttcagtttttgaaaaagcaaaaaaagcttatgataaaatgatgaatccagaacaacctgataacacaaaaccagcacaaccaacagatacaaaaaaagatagccaatctacaaataaagttgaaacaacaaatcaaaaaacaacttcagtaaaaactggagatgaaactaatgttgttatctttgtttcattatcaatggtgtctggtggattattcttagtattaagaaaagaatatgaaagagttcattaataaaataaaaaatatggataaaacaaaaagaattgtaatattatttattacaatttcttttgtttttattggtagtttttctatttataatggtgttactggaaattataaaaccaatcaagtagcacaagtagatactacaaaaaataagaaagaaaaaaatactaaggaaactaaaaaagaagagaaacaagagactactgatcaaacacaagaaacagagcctacacaaagtgacagtcaatcatcaacacaatcaacagatgaaacaaaaacaaatgatgaaaataaatcaaatagtaaatcatcatctacaactcaaagcaatagtaaaagtagtagtgcaggtcattctcaaagttctacgaatcgatctcaatcaaatagtggacaaacaagtaataatcagtcaaataattcatcaaccaatagttcatcgaatcaacaaccaactaatgaaaaaattacaataaatattcaagtaattggaatgggaaatacaatgatggctggtactttaaatgttgataaaaatagtaatgctttaagtgtattaaaaattatagcagctaaaaatggtaaagaagttgagggtagtgattattatgtttcaggaataggtggtttaaaagaaaagcaacatgggccaatgtctggatggatgtatagtgttaatggtgttgcgcctaataaggcagcaattaaatacaatttaaaagatggcgataaagttgtttggtattatgttaactatgaataggagactatatgcattcaagtaaagtaaaagaaattagtttaataggaatattagcagctgttaatattgcctctcgtatatatctacaagcattacctaatattaaacctgttacttctatcattattatttctgtcatgttatttggattaggttttggagttaaattaagtattgttacaactgttgtttctaatttgtttttaggcatgggaacatggactttctttcaaatacttgcgtgggttgttatttgtttgattacacaggttttattagattttttaaagaagatacataaggaaccaaaactgtttcctatggctatcttttccttttttatggggtatgtctttggtattgttgtttctctagaacaattaatgttaggtggtccttctttatatattgtttattatatggcaggattgttatttgatacttttcatgcagtaggaaacttttgtttttatttaatatgtgcacctattttaatgaaagtattaaaaaaggaatcagaaagaataagattaaaacaagactaagttcttgtttttctttttgattgaattataataaagtaagaatttatcatgaaaggatgattttatgatcgtaaatgaagaagcagttaaaaagatattagaggaagtaaaaccagcaaaacttgttgcagcaacaaaatatgtagatgttcatgaaatagaaaaattagaagaattaggtgtaacatgttttggtgaaaacagagtacaagctttcttagaaaaatatgagaaatatcatggcaatggtgaatttcaatttattggaacattacaacctaataaagttaaatatattattgataaggtgacattgattcatgcagtagatcgttattctttattaaaagaaattgaaaaacaagccgctaaaagagatttagaaatgcctgttttaattcaagtaaatattgctaaagaagaaagtaaacatggttttgaagtagaagaaattgatgaagtatttaatagtttaaaagattatcctcatgtaaaagtaagaggacttatgatgatggcaccacatattgaaagtagtgaaactgaaaagtattttaaaatgacacaagagcttttacaaagacttcaaaaagattatccaatgtatcaattggatcagttatcaatgggaatgtctaatgattatcatgaagctttaaaacatggatcaacaatgattagaattggaagtgctttatttaaatagatatgaaaatatctatttttttgtttaaataataaaatttcaaataatttgacatagtgtgacaaaagcgtataatgttagcagccgaacaaaaaaggagacatttatggaacatcgaataggaatggaaatacgtgttttgtctaaatatatgggacgttatttagatgatattcatggtattgattgtatgttatcaggaccgcaggggctaattcttatttatttatgtgaaaatgatgaagaagtttatcaaaaagacatagaaaaatattttaatattagaagatcaactgcaacaggtcttttaaattctttagaaaagaacggatatatcacaaaagaacctgttgaaaatgataaacgtatgaaaaaaatcaaagcaactgaacatgcgtatagtacagtagaaaagattgataatcatgttattcaattagaaaaaattatgttagatggaattgatgaaaaagaagtgaaacaatttagaaatacgatttctaaaatgacacttaatttagtaaaggagtcaaaaaatggataaattatattacatgggaattgatgtaggatcaacaacagtaaaattatatgtggaagatcaagaacatcaatgtatctattcaaaatatcaaagacactactctgatgttaaaccagcaatagaaagtctaattaaagaagttcaagaacaccatggaaacttaccagttaaagtagttatgactggatcaggtgggctttctttatcaaaacacttaaatgtagaattcgttcaagaagtgattgcttgtacaaagacagtagaaacatatattcctgaatgtgatgtcgcaatcgaattaggtggagaagatgcaaaaatcacttattttgaatcaactcttgaacaaagaatgaacggaacttgtgcaggtggtaccggagcttttattgatcaaatggcttctttattacaaacagatgctgcaggattaaatgaacttgctaaaaactatgaaacaatttatccaattgcttctcgttgtggtgtatttgcgaaaacagatattcaaccattaattaatgaaggtgcagcaagagaagatattgctatttctattttccaagcagttgttaatcaaacaattagtggtcttgcttgtggtaaacctattcgtggtaaagttgctttcttaggtggtcctctttatttcttagatcaattacgtacacgttttattgaatcattaaatttaaaagatgaagatgttatctttcctcaaaactcacaattattcgttgctatgggagcttgtttacttgctagagaagataaaattaaacaaacaagtatagatgaattagtgaatattttagattcattaaaagatggtatttctgatgaaacagatactttgaaaccattatttgaaacagaagaagatcgtattgaatttagaaatagacattatcgtactaaagtaaagaaaagagatttaaatacatatcaaggaaaagctttcttaggtgtagatgttggttcgacaacatctaaagctgtattagttgatgaagatggttctgtattatatacattctattcatctaatgaaggaaatccaattgaagttgttcgtaagatcttaaaagaaatctatgaaatcttacctaaaggagtagaacttgttcatgctggttcaactggatatggtgaagctttaattaaatctgcatttaaaatggatgtcagtgaagtagaaacaatttctcactttacagccgctaaatattttaaagatgatgtttcatttatcttagacatcggtggacaagatatgaaagctatcaagatcgaagatggtattattcaagatattttattaaatgaagcttgttcatcaggatgtggctcatttattgaaacattcgcaaaatcattagggtataatgttgctgatttcgctaatctagctttacaatcaacatcaccaattgatttaggatcacgttgtactgtatttatgaactctaaagtaaaacaagcacaaaaagaaggagctaagattgaagatatttctgcaggtcttgcttattctgttattaaaaatgctttatataaagttattaaattacgttcgcctgaaagtattggtaaatcagtattagtacaaggtggaacattctataatgaatctgttttaagagcttttgaacaagaaacaggaatcaaagcgattcgtccagatatcgctggattaatgggtgcttttggtattgctttaattgctagagaaagatatcaaggacaaggaacaacattacttaataaggaacaagttgatgctttcggttatgaaagtacaattcgttattgtcaaaaatgtacaaatcattgtatgttaacagtttcttcatttaatgatggtagtgaacatatcagtggaaacagatgtgaaagaggagcaaacttacctcctaaatcaaaacaattaccaaacttatatgattataaatatcgtcgagttttcaattatcgttcattaacggctaaagaagcaaaacgtggaacagtaggtattcctcgtgtcttgaatatgtatgaaaattatcctttctggcatacattatttactgatttaaaattcagagtagtcttatcaccacgttcaagtaaaaaaatctatgaaaaaggaattgaatctattccatcagaaagtgtatgttatccagctaaattatcacacggacatattgaaagcttaattgaaaaaggaattaaatatattttctatccttcagttgcttatgaaagaaaagaaaatgttactcaaggaaatcattacaactgtccagtcgtaacttcttatccagaagttattagaaataacgtagataacttagaaacaaatgaaatcatctttagaaatccattcatagatttaagtaaccgaaaaacaatgtttacaaacttaaaagatgaatttaaatcatttggtattagtgataaagaattaaaagcagcgattgaacatgcttatgaagaattacaacaatgtcgattagatatccaaggagaaggagaaaaagtccttgcgtacttaaaagaaaataatatgacaggtgttgttttatcaggtagaccataccatgttgatccagaaatcaaccatggtttagctgatttaatcactggtgaaggaatggctgttttaacagaagacagcgtttgtcatttagataaagaattagaagaattacgtgttgtggatcaatggacatatcactcaagaatgtatcatgcagcatcttttgtatcatcacaacctaatttacaattaattcaattaacatcatttggttgtgggttagatgctgtaacatcagatcaagtagctgaaatcttaaatgcgagaaataaaatctatacacttattaaaattgatgaaggaagtaacttaggtgctattcgtatccgtatccgttccttaaaagcaacaattgataaacaagaaaataaagaaattgatttatctaaaaaatataaaccagtgaaagtaccattcactaaagaaatgaaagatgatcgttggacgattctatgtccacaaatgtcaccaatccatttccaatttgttgaaaaagcaatgcaagaaagtggttataacttaaaagtcttaccatcagtagataaaggagctacagaagctggattaaaatatgtcaacaatgatgcctgctatccaagtatccttgttgctggacaaatgatggaagctttaacaagcggtgaatatgatgtcaacaaaacagccttgatcatttctcaaacaggtggtggatgtcgtgcgacaaactatatcggatttatccgtaaagctttaaaagatgctggtttagaacaagtaccagttatcagtgccaacttacaaggtatcgaatcaaacccaggatttaaaattacctacccacttgctaagaaagttattatcggtgcaatgtatggagatttattcatgagagtcctttatcgtgtaagaccatatgaaaaagaaaaaggaagtgctaatagactttatcaatcatgggtagaaaaatgtatgaaaaatattgaaacaggtagcatgaaagaatttaagaaaaatgtttatcaaatcgtaaaagattttgatgaattacctttattggatatcaagaaaccaagagttggtttagtaggagaaatccttgttaaattccatccaactgctaataatcaaattgttgatattattgaaagagaaggtggagaagcggttatgccagatttaattgatttcttccaatattgtttctattcaacaacatttgaaagaaaacatttcaatgcgacagctaaagctactaagctatgtgaattcgcagttaaagccgttgatttcttaagaaaagatatgatcaaagctttagaaaaatcaaaacgttttgctccaccagcttctattgaacatcttgctgataaagctaaagaagttgtttcaattggtaaccaaacaggtgaaggttggttcttaactggtgaaatgattgaacttattgaaagtggagcaccaaatattgtatgtatgcaaccatttggatgtttacctaaccatgttactggtaaaggagcaatcaaagctttaagaaagaaatatcctcaaagtaatattgttgctgtagattatgatccaggagcaagtgaagttaaccaattaaatcgtattaaattaatgttatcgacagcatttaaaaacttaaataaatagaaaaatagtggttcatttttgaaccactatttatattttgataagattgcaggttgataacatcatatttgttttattaattgaataatgatttttaatagcacaaatgattaaactatctctactttctttataggataatgtttcacattcagcaagagaaagcataaagtttgttttctttaaatcaatatttaaaactaaactcatttgaataagatcatctctttgaggttgaatttttccattaagaataccattcaaagtgttttcatcaattcttgtttcattatataacttgattgtaggaatacagtaatatcctaataaagcataaaaataagttaaaaaatctaaatttggaaattcgtgttttacttcatcaatattggcacatgtatcaacaagcataaataatctatcggcattcatcatatcacctacttattataattctaaccccttttaaatcattgaacaagtttaaaaatatttattttactaataatattttataataatagttttaaaaagattgtagaaaaaaagaagtaaaaaaaggatataaaatctaaataatttgcataaaatagtataaaagagtatgatatgaataagaaggggatgtttattatgtgcttaggattattaatgatgctcttggcaggtagtgtagtttattttggtaagagttattttgaatataaattgagggaagagtaatctagcattcgctagattattttttttaaaatgaaaaaactgattagtctacttgtattatttttattatgtggatgttttccacaatcttaccaaagtatagaaaataaatttaaacaagatcaatgttttaaatatcattaccagcttttaaataaaaaacaaaaacaactctatcaaataatttataatattgcttatacaagaaaacaaaatatttatattaaagaaaaagagatagataaagtgagtcaaattgttaatgcagttttaaaggatcatccagagttattttatattaaggaatggtctcttaatacaaaaggtctttttaattttgaatatagtatgaaagaaaaagaaattcttaaagatcaaaaaaggataaagaaaattgtcaaacaactaaaagaggatacacaagatttaaaatcctatcaaaaaataaaatatatttatgatgatgttattactcattgtaagtataatgaacaagcaaaatataaccaagaaataatcagtgttcttattaatcatcaatcagtttgtagtggttatgcaaaaacaatgcaatatctactcaatcaattgcattttaaagcaacatatttaacagggaaaacaataaaaggaagaaaagacaaacatgcaataaatatgataaaatatgacaatgattattattatatagatgcaacctggggtgatttagtattagatgatgaggaaatcatcaataataattatttgatgtttgatagtcaaacaatgaaacaaatgtatgatttagatgatcattataaaataactaaaaatgataaacatacttattttaaagaagaagggttgtattttgatttatatcaattaaatactttaaaagctaaaataaataaaaatcaaagagaatgttattttcaattttcaaatgaagtatataatgatgctaaagaaagattaacaaaaaaaggagatgcctatcgtttaatagaaggggtagatcatattcaatatatcacgaatgatcaattgaagatgatttatttaaaatggtaaagttatgaaaagaattaatgaaattgttgttgttgaaggaaaaacagatagccaattattaaaagaattatatgatgtagatactattgaaacacatggactaggattagatgataaaacattagagcttattaaagaggctagtaagacaagaggtgttattgttttaacagatccagattatccaggtttaaggattagaaaccaagtggagaaatatgtacaaaattgtaaacatgcttttgttgatagaaaagatgcaattggtaaaaagaaactaggtattgctgaagcaaataaagaagctgtaaagaaagcaattgaaaatgttgttacattttcaaatcaagaagaaagtatttcttggaaagagtttttagaattagatattattggagataaaaagaaaagattaaaggtttatgatttatttcatttaggatatggcaatgcaaaaactttgtttaaaagattaaatatggtgggtatttccagggaaatgatagagaaggagttagagaatgaaggatatagcgactaaaagtacaactcaatatatattagataaatatgatttatatcctaaaaagaaatatgggcaaaactttttaattgatcctcatatcgtagaaaaaatcgttcgttgttcaagtgttaatgaaaaatgtgcagtgattgaagtaggacctggaattggtgctttaactcaagtattagcacgttatgcaggatatgtaagaagctatgaaatagatacacgttttaaaggagtctatgaagagtttttaaatcaggaaaatattgagattgtttttgaagattttttaaaagtaaatttagaggatttaatgactttaaaggataagtatgaaaaagttattttagtagccaatttgccttattatattacaactcaaattattgaaaaggttttaactgaaagtaaagttattgatgaaattgtcgtgatggtacaaaaagaagtggctttaaaatatacaagcgattataaaagtccactgatgtatatgattgaagatatgggtaaaattgaatatatgtttacagtaagtcaaaatgtttttattcctgcacctcatattgatagtgctattttaaagattacaattaataaggaagctaatttagatttatataaagtattaaatagtgcttttaaacaaagaagaaaaacgatttataataatttaaaacaagaatatcaaaatgcattagatgttttaaatgaaaatcaaatagatcaaaaattaagatgtgaacaacttacattagaagattatcaggctatcacaaaatcattatataaacatactatataatggtgatagaatgaagataggtgatattgtaagtagaaaaaaatatcatcaagatattatttttgaagtcattgatatacaagaaaatatttgttatttaagaggaatagagtatcgtcttattgcggatagtgaaatagatgatttagagcttgttcaagagaaaagaataatagaagatgtgcatttaccacaagaaaaatgtttaaagggaagtgttttacatttagatggagatccttcttatttaaagatgtgtatgaaaaaatatcaagaatatggtattagagcatatggttattattttaaagaagaagagtttgctagtaaaataaccaacctattaaaaaaacataatccacatcttttagtcattacaggacatgatgccttgaaaaaaaatggacataaaagaaatagtcaagattatttgcacagtttagattttgtagaagcaatcaaaaaggctagagaatatcaacccgacaaagatgcattagtaatctttgcaggagcgtgtcagtcatactatgaacttctagtagcgagtggtgctaactttgcatcaagtccttcaagaaaaaatattcatgcgttagatcctgttattatcacaactcaaatcgcaagtacaaatattaaagagtatgttgatttagaaaaagttatagagaaaacctcttttaaacaattaggtgttggtggaattgatacaagaggggttgccagaaatttgtatccgaggtaatgaaaaatgaaagtaagagcatatgcaaaagtaaatttagcgttagatgttgtaagaaaaagagaagatggatatcatgatttagaaatgatcatggcacctattactttacatgatctcatttatattaatgtcattgatgaaggaattgaaattgagtcaaatagtaagatcgttcctaccgatcaaagaaatattatgtataaagttgcacaattgatgcaagaaagatacggattaaaaaaaggtgttaagatctttgtctataagcatattccaacgcaagcaggattagctggtggaagtgctgatggagcagcagttattaaagctatgaataaattatttcatttaaatttatcttatgaagaaatggctgctttaggaaaagaagtaggagcagatattccattttgtatttatgaaaaaacagcttttgttgaaggtgttggtgaaaaattacaatttattgatgaaccttttgaagcttatttattacttgtaaaacctaaaaaaggtgtttcaactcaaaaagcatttacttcattagatttatctaaggtaaaacatcaagattgcagaaagatgaaaaaaggaattgaaatgaatgattatcaagcagttattgataatctacaaaatacattagaacttccttctattaaaatggtgccacaaattaaagaaatcaaaaaagaaatgatgaagttaggttttgatggagctttaatgtcaggaagtggttcatgtgtatttggtattactagaaatcaagaaattatgaataaaggatatgaattctttagaaaacgttatttttttgttagaaaatcgaaaattttaaacaaggaagaaaatctgtgataagattttctttttttgaaaagatgtaggaatttgcaataaattgtcttattcatctttaattatgagttatattttgttagaatgacgtcgtagaggggtgtgacgatgaaaacttacgcagtagtaatggctgccggaaaaggtacaagaatgaaatccgacaagcctaaagtagtacatgaagttttatataaacctatggtttgtcatatcgttgatgaattaaaaggtttaggtgttgatggtatttatgttattgttggacataaagctgaagaagtcatgaaacttgttgatggtgttgagttcgtaatgcaaaaagaacaattaggaactggacatgcattgatgcaagcaaaagatgttttaggagataaagaaggaacaactattgttttaaatggtgatgcaccattaattactaaagaaacattacaagggttaattcaatatcataatgaacatcaaatgaaaggaacagtcatgacatgtgattgtgacttaaataagaaatttggtcgtattattagagaaaatgatcaagttaaaggtattgttgagtataaagattgtacagatgaacaaagaaatatttctgaaatgaatgttggagaatattgctttgataatgctgctttatttaaagcattagaatcagtaacaaataacaatgctcaaaatgaatactatattacagatgtaattgaaattatgaatcatcaaaacttaaatgttggtggttataaaattgatgacttatcagaagttggtggaattaatgataagtttgaattacaagaagcaacaaaacaattacaatatcgtattaacaaaaaacatctattagatggtgtaaatattgtagatatgacaaatacttatattggtagagatgtagtgattggtcatgatacaacaattgaaccaggatgtattattaaaggaaaaacagtgattggtaatggatgtcatattggaccttattgtgaatttgataatgtagaaatcaaagataacgtagaaattaaattctctgttattgctgattcgattattgaaaacggtgttgatatcgggccatatgcaagacttagaaatcattgtcatatcttagaaaatgtccacatgggtaactttgtggaaatgaaaaaagcaacttttggtaaaggaagtaaagctgcgcacttaagctatattggagatgcgacagttggtgaaaacgtaaatattggctgcggtactattacaagcaactatgatggaaaaaataaattccaaacagtaattgaagacaacgttttcgttggctgcaattctaatttagttgctcctgtaactgttggtaaaaatgcatttattgctgctggatcaacaattacagatgaagttcacgaagatgcttttgcgattgctagaagtagacaagtgaacaaagaaggttatagtaaagtattagaagaaaaaagaaataaaataggaaaataggggtaaaagaaaaaatgaaaaacaaaattacagtatttgctttatcatcatcagtagaattagcacaagacatttgtgataatttaggttgtgaaatgggaaaatcaaaagttcaccatttcgctgatggagaaatcttagttgaaattgatgaatcagttcgtggaaaagatgttttcattgtccaatcaacatctaatcctgttactgaaaacttaatggaaatcttagttttagcagatgccttaaaaagagcatcagctggagaaattacagctatcatgccatactttggatatgctagacaagatagaaaagcaaaacctagacaaccaattacatctaaattagttgctgatttattaacaactgctggtgttaatcgtgttgtaacaattgatttacatgctgcacaaatccaaggattcttcaatattccagttgatgatatgcaagcattaccattaatctgtaattatttcaaaaataaaaacttagatgatatctgtgttgtttcaccagatcatggtggagctactcgtgctcgtaaaatggcagttgctttagattgtccagtagctatcattgataaaagaagaccaaaacctaacgttgctgaaatcatgggtgtattaggtgatgttgaaggtaaaaactgtatcatgattgatgatatgatcgatacaggtggaactattgtagcaggtattgatatgttacttgaaaaaggtgctaaaaatgtatttgttgcatgtacacacccagtattctcaggaccagctgttgaaagattgaaaaactgttcagctaaagaagtagttgtaactgatacaattatcttacctgaagaaaagaaattcgataaattaaaagttgtttcagtagcttcattacttgctaaaacaattgaaaatattgaaaataatttacctgtaagtgaagttttccaagaatttgatttcgaaaaataatatacaaatataaagtcttccaaattggaagacttttttgtttcataagtaaaacatctataaaagtgtagttatatcaataaataatcatataaaaacatcttttatgttacacacctgaaacaaaataaaatattgaaaaatggaaaagaaatgctaaactctctttagttagtttaagctaacttaaaaagggaggtcaacatgaaaaaattactaaaaataacattagctctaatgatggcattatgtttacaacttacatcatttaattcagtacatgcattaaataatgatttatcaaaagcaggaacatatcaagttccaatcaaaagtctaacaagtgctgcaccaatttcagcagtacaaacagcttttgcaaaagcatttggagattcattagaagtaacagtaaatgaagatggaaaaatgcaagcaattgctactttacaaaatatgattattaatttagggaaagaatattatgcaaatgttctaacaattgctaatggtacaacactttcaacaaaagttgaaaagtctacacaaggaatgaatggacaaacagtagatgtagatgttcctgaaaagattttatttgatttacctcaattagatgaaaataattcaacagtattatctattacagttgattttatgaatgctatgatgggacaagggaatgattatcctacaaatgtaacattaacattagatttagataatgttcaacaattacaaaaagaatatgttttagaagatggtacatataatgttccagttgatgttttaaaagaaaatagtgatggtcaatcaatggcagctaaggcaattgaatcagcacaaataaatgttaacaataatgaagtgactgttacattaaaattaaaagaaatgacaatatatggtcaaacagcttcagttgataaaatggaatatcaattaaaagatggaacatatcaagaagcaacaattattgaagaagaaaatggacatccaacaaaggttcaatttaaattagatcaaaatgtaaaacttacaaatgttaaattctattacggcggaagtaatagaggtgctactgctagattatctttagatttagatcatctaacaaaagtaattccttctagatttaatcaagatggtacatatagtgtagatgttgcattatggaatgcaacaagtgataaagcatctatggcagctgctgctttagattctaaagctaaaattattgttaaagatggaaaagcaacaatgtatatttctacaaaagaaatgtcatttggaacaattaaagcaagtttacaagaattctatattggaagtgctcaagaagattataaaaatcatagtgctacaattatagaaaaagatacacaaggtaatccaacattatggtcatttgaattacctcatgaagatgaatatatcaatgtaatgatgaatccacatgttgctatgatgggtaatatggatttagaagcaagaattaaagttgattatagtacattaacatatatttcagataaaactgaattagaaacaaatactaaaaaagaagatccaaaagaaagtaatcaaaatcaagcaagtaatacagctactgaaaataaaacagaaactacaaaagataatcaacaagaaagtcaagcagtaaaaacaggagatcaagcccctatcacaatgatgagtgtattaggtatgatttcattgtttatgtttgttgttttacaaaaaaaatatgaggcataaaatatgcctcattatttctatggaggaattatgaaaagaatattacagataaatattattgctttgatgatattgttatttttatcgccagtaaatgctttaaatgatggtgcttatttaataagtcgttcaacaagttatgttaatcctcttacaggtaaaacagaagatggtggagaaaatattgctttaggtgatagtatggtaggtaatattgttgaaggacaattattacttgaacaaacaggaggaaaatattatatcactgtaggacttggattagcttctaatgttagtaatgtacgttttaaagtcatgacatcaagtggtgctatgtcttctgtatcagcaactaaaacaggaagtagtagtgcaaatggagatacagttaatcattatagaatacaagtaagttcattagatatttatattagtcctattatgtatgtaagtcctatggggagagatgttcagttttttattaaatcaaatatttcctcggcaatatctggaacaggtgtttataacagccaaatgattccacaaagccaagcaccaacaacatcaacacaaaatcaatcaagtacaacaactcaatcatcaacaccaacatcaaaagcacaagaggaaacaactccagaagaagttgaaaatacagaagcgccacaagctacagtagggacaattacaaaagaatcattaatggaaaatgcgacagggttaagtaatcatttaattaattcaaaaggaaaagtagatagaaaattaaaattaactatcaaaaatataaaaaagaaaaatcaacaggaacaaaaagcaagttctcattattctttatggattattggagtcttaggcgtgatcgttataggaggtgtagtttatgttaaaaaagttaaaaaatagttttatttttatttgtttaatttctttattaaccggatgtgttaatcaaaatcaagaagtccaaacaaatgaagaagtaacaattgctgctacatctgtttctgtaactgaaatattagaccaattagatgtaccagcaaaacaggttgttggtattcctcaaagtgatagttattcagttcctaagaaatataaaaaggcaactcaattaggaaatgcaatgtcaccagatatggaaaaactttctacattaaaaccagatcttattttaagccctaattcattagaaggtgatttagcaagtaaatatgaaaaaataaaaataagttcaagttttttaaatttaaaaagtttatcaggaatgtataaaagtattgaagaattaggaaaattcttcaataaagaaaaaaaagcacaaaaattaattgatgattatacaaattatatgatttcttttagagaaaaatatcaaaacaatgtgagcccacgtgtacttattttaatgggtcttccaggaggaagttatgttgtagcaactgaatctagttatgttggagatttagtaaaattagcaggtggtacgaatatttatggagatggaaatggggaagattttgttaatgtaagtgtagaagatatgttaaaacaaaatcctgatcttattttaagaacaagtcatgcaatgcctgaaaaagtaatggcttattttcaagaagagttttctaataatgaaacatggcaacaatttgatgctgttaagaataataaagtatatgatctaaataacgaatattttggaatgagtgctaattttaattatcaaaaaggattagaaacattagaaggaattttatatgaaaatcattaaaaagaatccgttattatttatattaggtttaatgattattttaggaatatgcttttttctagcaattaatataggatcaattaaagtatcttttatacaactaatgaaaggtttatttatagaatataacaaagatgtagcaagtatttatcaaatacgttttcctagagttattgtaacaatgcttgtagggtgtgcattagctttatctggattattatttcaagttgttcttaaaaatcctttagcagatcctggattaataggaataagtgcaggggcaaatattgtgagtcttttagttggtatttttttacctgatttatatgtatttaaaccaatgattacatgtctaggaggcttagtaacatttattattatttatagtttatcttggaaatcaggtttaaataccacaagaattattcttgttggtgtagcaattcattatactatgaatgccattgtttctcttatagaaagtatgtcagcttctatttcatcttcagcaggaacaattactttatattcatggaatgatgtatttcttttaatgatttatattgtgccaattttaataatcttactttttttaacacaagcatgtgatttattaggattagaagatcgtacattattatcattaggaatcaatgtaaatacatatcgttttattttatctttattagctgttttattatgcagtatatctgttgctattgctggaatattaagttttgtaggtttacttgtgccacatttagcacgtttatgtgtaggtaatcaacataaatatcttattcccacaactgccttatgtggagctattattgtattagttgctgatacaataggtagaacattgatggctccttatgaaataagtgcaggaattattatgtcaatgataggtggtccaatatttatcttattattaaaaaggagtttatatgaaagttaatcatttatcttttagttataatcatcaatcttatatgaaagatataaatatacagtttaaagatcaaaaaataacaaccattattggacctaatggaagtggtaaatcaacacttttaatgctattaagtcgtatttataaaatacaacaaggatcaattgagttagataataaaaatatatgggattataaaattaaagaatttgctagaaaagtagctgttgtacatcaaaagaatcaagtatatggggatttaaatgttagaacaatcataggttatggaagattaccttatcttaattatcatcaatctctttcaaaagaagataagcaaataatagattgggcaatagaagtcacaaatcttaaagaacatcaaaataaaatgttaaatagcttatcaggaggacaacaacaacgtgtttggatagctttagctttagcacaaaaaacacctatacttttattagatgaaccaacaacatatttagatattaaagctcaaatagagacacttaatttattaagaaaaataaacaaagaatatcaaatcactattattatggtacatcatgatattaatcaagcaattcattatagtgatgaaattatagcaatgaaaaatggacaactgatgtttcaaggaaaacctcatgaagtgattaatcaaaagactttaaaagaagtttatgattatgatttaaatgttataaaaaataatgaagaattatttgtattaaattatcaataaaaatgtatcaacttatagatttaagttgatacattttctttatgattgaaaatattttttaatctcatcaatttcctgttgaggtaatccaagtaattctactgcgttagaaaaagtagtatttaaattatgaataagattttttactaccatgatatttcttttttttctttcactttgtttcgttttttgaattgcttctctttcaatcatttctcctaagttacacatcttttctacctccttatcgtttttgccatagtccaaattaatagcgtgttggaagcatctagcaatatttgcttgagtcttaggaccatatgcaccatcagttgcaattgaatgacctgtaaaattgattgaatgttgttgacctcttgaaataatactgtctaagttgtcatttttagctgcagatggagtagcagtagatgtccctagatttccaacagttgaattaacaatattgtttttaaaatttttccaaacattgtcatctaaaagtccattacaattaggacataatttaccatttacatcataatgacgataaacatgatcaatatcaatgctatattttttcatcaacgcacgtgctaatgcatatacattttctaatgtcttatcggtaatttcaacaacaccatttttattggaatcacacatttcaatcgacaatgaattactgttagtgatgatttgatacattggatgatgagccgattgacacttaccaccaacactataagctgcgtaatcatctggaactgaatgtgtaactgaatcatcatcaacaaagtaatgggcagaagctttaactacgttgttagcaaaatattttccatttgattcatcactatctccatcattacttgtataatgaatgactaaatatttaatttttgataaatctctttttgaaccataattagctttattcgctaaatgttctttcataacataactcatatgctatttcctcctttttttaaataaaaagagagctattcactctctttctctaattcttctttgatttcatcaattcttttccaaattgcttttgtttctcgttcttgaagtgccatacgttcaactacgttattgtgcttttcaactttctttgttaattcatcaatacgatagttcattaatgtgttggctttattgtttgaaaacattgtagtgataacactaggcacagctacacatagaccagaaatcaaagcaactgtaactgcttctgtcatatgcttgcactcctaactttcatctacaatctcttccaactctggaagccctgcaacgcttgttagaatagaaacaacaccagatagacaacttgcactgatgatcattgcccagttgacttcattcatcactgtagacgttccaattaacgcaactgctgtttgagctactgttttgattgctcattaatatctttgatataaatattttctttatttgttttctagaaatataaaaatataaatctgtttgtttttgtttttcatagatgaataatttgattactaagataatacaaaatataagggataatagatattgaaaatcttgattcataaaattattgattaaggtataatcatagtagtagctaagatttctattttttaatctttttttaagcattatattttcttttttccatttactattttgagtttttttaatattttcatctagaatagtgattttatttttaattgaagaatgataattgattgtatattcataatcttctaataaattattacttatctgttcatcaccgaaaacataacctgaaaaagtatttttagacttgtttttggtattatagttaccattatttacttgttctaacatcgtattatgataattaacaagccaatcatatttttgttgagaaatagggccttcaattatttttaatatttttctttttcctgtattaatatctccatatatattttgataattgacatatatgatttgtaaactgtttaagataagcaaaagaataaataagactttaactgatttagaacgtaataacttatataattcaccttttatcataaacatcaccataataataaagataaatatcttctaaatttatttctttacaatgtgggaataattcatctttatgagaaaaaaacttaattttataatcatcgttaataggtacaatagaagaaacatgataagtttctatatatttttgtagatctttttttgaaacaatcgtttcataaaagaattgttttaatgataatattaattcttgtggacttttaaaatctaataattgtccgtttttaaagaatataagagatttagctagatgatccatatcttgaataatatgagtagaaataataataattttattttttgaaagatttctcaagagatttttaagtcttaatctttcaatagggtctaaacctgttgtaggttcatctaataataaaatttgagggtcatttatgattgcctgagcaatagataaacgttgcttcattcctccagataattttttaatcttgatatatttttgatcatataaattaactaattttaaagtatgatctatttgatttttatcaattgatttgagtgcacaaatatattcaagaaattcattacaagtaagatcaacatataaagcaggagattgaggaacatatccaaatacatgataaaaatcatcacttaaaaatttaacttcatcaatttcaattgttccactatcatttttaataagtccacataaaatacttaaaaaagtagtttttcctgctccattaggaccaattaatccatagattccagatgataaatgtaaagtaatatgatctaatgcttttttgttcttataatactttgataaatcatttatataaatattcattactttaccaccaatgaagtactttcttctggaagattacttgaaagaggaatagcaatagcttttacattttttgttttattttttggtttatagcttaatactgtacttttatttttaggaagttctatatggtaactagatacaggttttaagtcttctaatacccaaagaatataattatcagaaataccactcatttttatagtaataggtttatttttcttaaaattaccatctaagttattaggaaattgaataagtaaattattatcaaaataaccttcttcatcatgttttaataaatcagatgtataatcaattaaatcataattattatttaaatctataggattattagcagtatcttgatgaatatcaataaaagtagtaccacaagccatcatatgttgtttattagtaagttgtttaagagaatcaacaatttcataatcagctattaaaaaagcatgcatataaagatgatcacctttactaccagtattaggcataatagaaacatgctcagttttattagtgtctttttttcctttaaatgtgtagactaaactttctttatcttcatgcttaatcatttgaggaataccattaataaatatcattaaaccaaaatttgcatctctacctacaacttcataatcataattaatatctacatcattaccctcaaaactataaccatcttcaatatgatgcaatccaaaacctacttttaaatcaactgtttcttgattgttgttctttttaatcgttatattttcctgtttggtactacatccaacaagtaaaaatatacaaaacatactgagtattatttttttcattctgttacctctcttcttataaaagtagttttctcattctgtttacctataataaataattgatgatcaacatattcagcaaataaaatattatctagctcattaaaatcatattttacattattgaaaataatataaggtttccaatcatcaacacttcctttttctgtaataataatctttccattacttaaataacaatttacagaattttcataattaaatcctaaatcattaaatccattatcataataaacagcaatcttatccttattagcaccatagccttcatcttgattatgaataatacttttatctttaaaagaacttaaagtaacttggggactattatataaactataagtttgatgatttatatctattaccccataacatccagaagtttgttgaccttgttttaaatatgttccaccagtataaataagggttttatcatttgtgaaagctaattcccatatagcatttaattttctaggtgtatcatctaaagtaagaacagtgctaactaagcgagaatctctatctaataataaaacactttctgtatcataattcatttttacacatgaaataaattgaccagatgatgaaatagctaaactatcatattcaaattcatcaaaaaaattatttaaatcaatatgatttttaagtttatgattttgaaataagaataaagtgtctgttagttgaatagcatatatatcttgaagaacatgtattttagctttattaacaggcccatcaaaaatcattgtgtttaataattctttatttttttctatagaataatcataaacatatgtttgattattttttttataaacgaatattaaattatgatctatgattttaaaatcaatgatttcatattttgataattgttggtaatcttgagttttcttaactgtttttactttatgattatttgtggtttgacagccacatagtaatatgactaaaaaaattattattatttttttcatagttaacctcattatagaaaatatcatttttgataataactattaaattatcaaaaatgatatttatattaatttaatattgtgtagatgtataaacatgatatccagttgtatgaatagcatcatgtgttccataaaatgtaactttagttccagcatatccccaacattctaatgtatctccaacaccagaactatttgcatgttggttttgagtagaactaatattagtaccagtgctagtttttttagcttctatttttattttgatagatttaacattttgaccaatagtggtaccaccttcacacaatttagatgatccactattataaggagatataaatccttttaatgtaccatatggtgttgattttgttgttgatttagcagcggatacagagtttacatttccaaatgccataagtagtgcgaaacttaacgttacaaataatttaattttatttttttataatttaatattcctttcattagtttaggttgacgtctaccttagttttattatatcttatattactacattgtcaataatacctttataataatagtatggtaattataatattatactgctataattattttggtgataaaattatggcaaaatcaaatagcttttttaatattgatatgcttgttttaagtttgttaaaagtaagtgattgctatggatatgaattagtaaaaaaaatcaaagaagtttcaaataatacattagatataaaagaaggtacactttatcccgtagtgcataacctattgaaaaaagaatacatttctagtcgagatgaaatagtaaataaaaaagtaagagtttattatcatattgaacctataggaagagactatctagaaaaaacaattactgattttagaaaaaatattaaaggtgtattcgatattattgaatatggtgaggtggaaaaaaatgaataaagattcaaaaaaatttattaaatatgtaaaaagaataattcctatccattcaaaagataaaagagaatttatcttattattatctcaaagaataaaagaattttcagatgatttagagagatgtacttatcaggatattgtaaatgaatttggtacacctaatgaggttgcaggatcttatattgaaaatatggaaagtaatgaactcataaaaaaactaaataggaaaaagttatttaaatattttcttttaacacttctaattttaataactctattatggggatttaaaatgtatagattaaatcaattatatgaagaagcaaaatcagaaacacatggttatattactgaagaaattattaaataaaagtagaaaatttatgaaaaaaattatattatttttaagcttattttgtattttatgcataccttcacaagtaaatgcttataattatgaaaatatttcacagatagaatatttggaagatggttcgtatattgaaacaactatatttgtatctaatgattatgctagatctcaaaaaactgctagtaaaattgctagatataatagtagtacgggcgttcaacaatggtatgtaactgtaactggaacgttctcatatgggaatggatcagcaaaatgtatttcatcatcagttaagtcaggtgtatataataataaatgggctatttcgagtaaatctgcttctaaatcaggagcaacagcaatagcatctgcaacagcaaaacatagctatgataatacagcttatgaaacaaaaaaattaactgttaggcttacttgtagctctacaggagtattatcataataattgaatagcattacaaggtaaatatcagatttcattaagttgtatagcatttgtcattttatataattgtatgtttataattatatttaagtatttgttatttattgtttttgatatgaattaactatccagtattaaaatataatcctcagctcataagtaaaaaaggaacgtctggacatggaattggtttatcaagtgtaaaatcaactttaaaaaaatataaatctgaaatatctttttaagaagataaatattggtttactgttcttatagttattgataaatacgaatatattcattagtattcatttaaaagaaattgttcatctacaatttcttttttgttataatgtggtaaatgaggtaatgatatgaaaaaaacaaaagaaacaattattgatgctttttggcaattattagaagaaaaaccatttaataaaataacggttcaaaacattgtcgaacgctgtcatttaaatagaaatacattctactatcattttcaagatatccctaatttagcagaatatactgttaaatcatgggcagatcaaattattcaaaataactatgaatttggttcaccaatgacatgtcttgccccacttatagaagaatgtaatcaacataaaaaagcttttcaacatctttataattcatcacaaaaagatgagtttattacctatatgaatcatgtagctttacatattgtaaaattgtttatgaaacaatcttctcattatgttttacgaagtgaacaagaaaaagaaacacttattcatttttataaatgtttaatgataggtattcttattgattggttagaagcacaaggtgattatgatttaaaaccatttgttgaacaaatatttcatttaatagaaacaacaatacaggctcattaggagccttttttggttaattcttttattttgtccattttatgttgatataaataagactatagtaaaagtagaaagaaggaatgaatatgaaaaccttaaataaagtaaaaataagtatatggattaatgccttaagtgcaatagtaataggtatattatttttaataaatcctcaagaatcttttcaaattattacaatacttgctggtattattattacttttacaggaattgttgattttatttattattttagtggttggttagatatttattttatgaagaatacattattgagtggtattttaaaatgcgtattaggtatctttgtattaacacatatatcaatgatgacaacattcttttcttatatttttagtttatatatcattattagtgccatctattgttttgaagcttatacctttattaaatcaatggttagttattctttaacttttgattatattattgttacaattttaattttcacaggacttgcaatgttctttttgagcccaagtacagtcatttcctctgcttttgtgataggaattttattccttattaatggtattggaaacttatttattgctttaagactttcaaagattacaaaagaatatcgtagatatcttcaataatttatactttagtatcataaatcataaaagtgggcatatattataatgagccctttataaaataccatatttataagcatatatttgtttaaatcctaaaatattacaaaatatatttttattcattcaaaaaaacaccgataaaatggactaaaatattttttaaatgaatgaaatcttttagaaatttgacaaagagataatattttgttagtattcaccagggtgagatttatgtactttgatacacattgtcatttaaatagtgaacaattatatgaaaaaaaagatgaatttattaaacatgctttagacaatcatgtagaaatgatggttgttgtaggctatgatcttgagtcttccaaaaaggcagttgaaatagcaaaagaatatccttttatctatgctgctgtagggataggacctaacgactgtttaaacacaactactcaagatttacaaatcatcgatgagtacttaaatgaaccaaaggttgtagcacttggtgaaatcggattagattattattgggatgatgttcctagtgataaacaaaaagaagtttttcaacaacaagtagatcttgctaaaaaacatcaaaaaccaattattattcattgtagagatgcttatgaagatacttatgaagtgcttaaaaaaaatggacatccaggaattatgcattgttatagtggatcagtagaaatggcaaagagatttattgatttaggtttctatatttcattagctggaccagttacttttaaaaatgccagagttcctaaagatgtggcagaaaaaataggtttagaacatttattaattgaaaccgactgtccttatttaacaccacatccttatcgtggtactttaaatgagcctgcaaatgttgtgtatattgcccaggaaatagcaaagctaaagaacatggagatagaaagcgttgcaagtcagacaacgtttaatgctaaaaaagtatttggcattaaataggaggaaaattaatgaaaacaattaaacaaattatttcagatgcagacccccgactgaaaggggtattagtgattatggttgtatatgtaatggttatggcgacaactgttacatcaggagcaacacaagaaataaaaggttataaagaaacaattgaaatacagtatcaagatggtggccaagaaactaaagattatttagtaagacaagatactgttaaaaatgtattaaaagaattagatgtaaacttaaacgcaaaagatacagttaataaagatatgtcctatattgtacaaagtaaggatttattacaagtaaatcgtattaacgaagaagaagtagaagaaatgcaatatgtatcttcacaaacaatagaaacaactggtttacatttatttacaactgaagttgttcaaactggacaacaaggacaaattaagaataaagtgaaagtcacttatgaaaacggtaaaatagtaaaaaaagaattgttatcgagtgaagttgtaacagaaaaaacagatacaattatcgctcatgggacaattcaacctggagcttattttactggaaaactgacaacatatggtggcgattgtgcaggaggaaatggaacttcatcatcaggtatttctttatcaccaacaactggtgttaaaggaagtcatagcgcgaagttaagttataatggtggaagttattattgtttagcagcagatccatctattccttttggaacaattattaagattacaaatcacaacttaggtattgaatcaacagcgtatggtattgttgttgatagaggcggagctattaagaaaaatcatattgatatttttaatggaacagaagctggcaaatactttaaaggtggtacgtcaaataatacacaatttgaaatcgtatctgttggtagtggcaagaatttttggaaatagataacaagtatatctcaaatgaggtatactttttttgtggggtgatgatatgaaaataggtgttattcaagcttcgtcgcaaatagaaaaaaatactattttatatgaatgtacaaaagattatggggaagttattaattttggttgctttgaagatgaagaaaattattcctatgttgaaattgctttagaaatttgtttgttgatttcaagccaagcggtagattttatagtgacaggatgttcttcaggacaaggaatgatgattgcttgtaatagtctaccaaatttaatttgtggctatttaccaacaccacaggatgcttatttatttggaagaatcaatgatggtaatgtggcttctttaccattaggtcttaactatggatgggctggtgaaattaatttaaaagtaactctccaacaattgtttgaagaaccttttggaatagggtatcctttaaaagatgctaagcgaaaaagagaagatacaaagaaaataaaatctttaaatcaattatgtaaaaaagatattattgagtttttaaatgaaatcgattcatcattcattaataaagttttatctaaaaagaatgtaatcgattatattttagaacaaggaaaagatcaaagaataaaacaatggattttaaacaggaggtaatcctgtttttttatgaaaaaagagtgataaaacgtacgaaactcatctttttttctcgtcaaaaaagcaatgttggtgtacaatggaaaagaattgaaagggagtgtaagtgatatgtatgacgtaatagttgtcggagggggacatgctggaattgaagccagtttagcaccttcaagaatgggattaaaaacattacttgtcacatcaaatataaataatattgggtcaatgccatgtaatacttctattggtggacctgccaaaggaatcattgtaagagaaatagatgcattaggtggacaaatgtctaaaacagctgataagacttacttacaaatgaaaatgttaaataccgctaaaggaccaggagttcaatctttaagagcacaagctgataaaaaagtatatcctcgttatatgcaaaaagtggttaaggaacaagaaaacttagatttaattgaggggatggttgaagatttagttgttgaagatcaaacagttaaaggagttattcttgatgatggaacaacttatttatcgaaaactgttattctaacaacaggtacttatttaaaagcagaaattcttgttggacatagtaaacatgctagtggaccagatcaacaaaaagaatcaaaattcttatctggaaaattaaaagattacggatttagaattcaaagattaaaaacaggaacaccaccgcgtgttgaaatcaatagtatagattattcaaaaacatcattacaaccaggaacagatgcaaaactagcctttagttttaccacagatgaatatgttcctattgaaaaacaaacaccatgttatctaacttatacaaatgaaacaacacataaaatcattcatgataatctagaaaaatgtgcaatgtatagtggacttgttaaaggaattggaccacgttattgtccatccattgaagataaagttgttaaattctcagataaaccacaacatcaaatcttcctagaacctgaatcaaaagaaatgaattcaatctatgtacaaggtttttcaacatcaatgccacatgatatccaagaacaaatgattcgtactttaccaggattagaaaactgtacaatcttaaaatatgcttatgccattgaatatgatgcaatcgatccattacaattatggccatcacttgaaacaaaagtgattaaaaacttatttacagctggacaaatcaatggaacaagtggttatgaagaagctgctggacaaggattaatggctggtatcaatgcaactcttaaagtaagaaatgaagctcctcttgttttaaagagagatgaagcttatattggggtcatgattgatgatttagttactaaaggaacaaaagaaccttatcgtatgcttacttcaagagcggaatatcgtttattaattagacatgataatgctgatgaaagactttatgattatagtcatcaaattggacttgttaaagataaagaatatcaaagatatcaaactaaaatgaaagggatctatgatgaaattgaacgtttaagtactattcgttttaccccaaaagatgatatcaatgaaatgttggaacaaaacaattcttcacatttaaaagaaggggtttctgcaaaagaacttattacaagacctgaaatcacttatgatatgatgttaccttatattgatgcacctgaattaagtgaggaacaaagaagaagaattactattttaattaaatatgcaggatatattgaaaaagctaaaagacaagcgcaaaaacaaatcaaaatggaagaaaaacatattccagaagatattgattatgaagatgttaaaaacttagctttagaagcaaaacaaaaattatcagaaattagaccacttaccattggtcaagcttctcgtatatcaggaatcaatcctgcagatatttcagttttattaatttatttaaaacaaaaatataatggagaataagaatgaatgaattagaatttcaaaatatacttaaagaaaaaggaatcgaagtaagtgaacatcaacttcaacaatttcaaaaatattatgaaatcttagttgaatggaatgaaaaaatgaatcttacagcaattacggataaagaagatgtttatttaaaacatttctatgattcaattacgattgcttttgattttgatttcaataatcaaaccttgattgatgtaggagctggtgctggttttccctcagttcctttaaaaatcctttatccaaatttaaagattacaatcgttgattccttaaataaaagaattactttcttaaatcatttatttaaagaactggaattagataactgtcaagcagtggctgcacgtgcagaagaatacgctaaagatcatcgtgaaagtgttgatatcgtgatggcaagagcggtagcacgtttaaatattcttgatgaactttgtttaccacttgttaaaaagaatggttatttcttatctttaaaaggaagacaagcaccagaagaagtaaaagaagctaaaaaaggtattcaattattaggtggacaaatagaaagtacacatgattttacacttgcaaatcatgatgattttagaagtaatattattattaaaaaagtaaaagaaacaccaaagaagtatccaagaatgttttctaaaataaaaaagagtccattgtaggagggtatcatgtttaataataaattaaaaaatatagatattaataaaatacaagcaaatgagaatcagccaagaactgtttttaatgaagaaaaaattgaagaattagctgcttctattaaagaaaatggtttaatacaacctatagttgtaagaaaagtaaatggaatttaccaaattattgcaggtgaaagaagatatcgtgcttgttgttctttaaatatgaaacaagtaccatgtattattgaagattatgatgataagcaaacacaaacacttgctattattgaaaatattcaaagagaagacttatcaccattagaagaagcaaaagcttatcaagctttaattaaagaatatggttatagtcaaacagagcttgcagatattgttggtaaaaaacaatcaacgattgcgaataaattaagattattaaaattaagtgatgatgttaaattttctttaaatcaaaaacaaataacagaaagacatgctagagcaatgctttcattaaatgaagaaaaacaacaagaagtcttaagagaagttttaaagaaaaaactaacggtagctgatacagaaagacttattaaaaaagaaccaaaacctaaaaagaaaaaagcatcagctgatgttaaaaaaacaatttcaagaaatgtgaaaattgctttaaatacattacaacaagcaattggaatgattgaaaaaacaggaacatcacttcaacaagaaacagaagatttagaagatgaatatgttattacaattagaatacataagtagagggttaagatgaagttactagcaacagatatggatggaacatttttaagagatgataaatcctacagtgatgaatttaatgatttatataaacaaatgttaaaacaaggaattcaatttgtgattgcttctggcaatcaatatgaagcattagtttgtaaatttgatgaagaaataaaaaatgatctttattatctttgtgaaaatggtacaaagattgtttatcaaggaaaaacactttataaaaaagcattaaagaaagatgatgttaaagaagttctagatattttaaaacaagatcaagaatgtatgctagtcgtttcaggagacaagcatgcttatatttctaaaagctttgaagataaaaaagattttatttcattatttatgaaaaatgttcaatttgtagaaagctatgatgatattgaagatgatatcttaaaattctctatcgcaagctttgatgatcaaatggaacaaagaattgaaaagattcaaaaacaattaaagcctcatttaaaattagtaacaacaggtaatgtttggtttgatatcttttataaagatgtgaataaaggaacaactttaacacatcttttagaaatcttaaagattaaaccagaagaatcaggagcctttggcgatcaaatgaatgattatgaaatgttacaaactgtaaaatatggttatgcgatggctaatgccatgccacctgttaaagaggttgcttatcaagtgattgatagtaatgaaaatgatggcgttattttaaaaataaaagaaatcttaaaaggtaactattaaacaatgcgtaagcattgttttttttgtataataaagacgttaaaacaaggaggaagactatgaaaccaaaattacattttacagcaccttatcattggatcaatgatccaaatggacttatttattataaaggaaactatcatatcttttatcaacatttcccatatgataataaatggggaacaatgcattggggacatgctattacaaaagattttgtcaattttgaacatcttccaattgctttatatccatctaaagattttgatagaaatggatgtttttcaggatcagcaattgaaatagatggccaactttatctttattacacagctattaaatacgctaaagaaaatccaagtaatgtacacaatcaatatagtgatgatgatttaagagcctcacaagcactcgttgtaagtagtgatggaattcattttgataatgttaaaaataaaaaacaaatcattcccatgattcaagaaggatttattggagattatcgtcataccagagatcctaaagtatggaaaaaacaagatggaaaatatgccatggttattgggagtaaagtagcttatgaaaatgactactgtggaaaagcacttttctatgaaagtgaagatggaattcattttgaatataaaaacagctatcaagaaccaactattggaaatatgtgggaatgtccagatgtctttaacatcaatgatcaattctttatgattttctcaccagaaaatacggatcaaccaccaaaaccaaatagtaatgcgcgttatatgccgattgattttgatgaagatactcttactattaaagatcatggtgattggccttatttagatcatggtttagatttctatgccccacaaacatttttatctaaagataatgaaagattattactaggatggcttagaatgagaaaacccgttcaaggagaagaatggattgggatgtttattatgccaagaattctacatgaaaaagatggtaaaattattcaagaattgtatcctaaaataaaaaactcatttaatcatgaagttcaagaaatttcatttgatcaaccattccaattaaagacaacacttaataaggatagttctttaaatcttggtggttttaaaattgatattcaagatgattgtctccatttaaatagagaagaagtatctattcaagaaaataaagtatgtaatgatgttgtttcacctaagttacaagggcattatgatattgaactttattatgatcatcatgtttttgaaatttatattaatggtggtgaatatgtgatgtcacaagttgtttatgatttaaatgatcaagttattattcaaaatacagagtataaagtctatgtcagatcattataaattctttagtcataaacaatgtgagtattatccttgtcatcaattagatgaaattaattgtttgttttgttattgtccattgtatattttaaaagattgtaaaggtaattataaaatgataggggatataaaagattgtagtggatgtactttacctcatcaaaaagaaaactatgattatattatttctcgttatcaagatgttgtaaaaacttttcaattacttgacaataaagatacaactgataagatagaagcaccggagggtattgaaaacaatgttggataaggtttagaccttatccagttttttttaggaggaaattatggaacaaagacttttaaaagaaaatacttttaaagcattaatgatatttgctttaccttatatgttttcaaacttattacaagtattctatgggtcggcagatatgtttgtagtaggacaatttggacatacctttgatgtttctggggtttcgataggaagtcaaaccatgtctttaataacaaaccttgttttaggattgactacaggagttacggttttattaggacaatacctaggaagtaaatcttatcgtgatctatcaaagaccattggaggggctattgttttatttttaatcattgctttagttttaacttttgtgatgttgtattttaataatgaaattacacttttaatgaatataccaaaagaagctattgaagcaacgaaaagctaattaagtatattatctttattgtcggatataatgttgtcagtagtattttaagaagattaggggatagtaaaacacctttattgtttgtttttattgcgtgtatcattaatattattgttgattttgtttagtaggatattttcatatgggagctaaaggggcagccattgcgacagtatcagcccagggattttcttttctctttgccttggtttatttatgtaaaaagggaatagggtattcgttttataaagaagatatttgtttttcaaaatatattcaaaagattatgcaaataggttttcctttaggattacaaagtgtacttgttaatatttcatttttaattattacgattattgttaatcaaatgggtttgattgcttctgcatctttaggtgttgttgaaaaattaatgggatttttaatgttaccagcgattgtcttaggaagtgttttagcttctcttattgctttaaatgtaggagcaaaacaatagaaatgtgcaaaacaaacattaaaatatgcaatcatgatttctcttgccttcgcaattgttgtaacaacgatttgtgaaatcgatggaacaatacttacgtgtatttttaccaataatcaagatgttattaaaaatggtgccttgtatttaaaaacgtattctattgattgtttacttacaagttttctcttttgtatcaatggctatttaaatggttacgaaagaactgtctttacgatggtacatagtttagtagcgacttttgttggaagaattcctttaactttattattttctaaaataccaaacgtaacactattccatatgggaattgcagctccattatctacaatgatttctttagtaatgatctttatttattttaagaaaacaaaatttgataatattaaagagagataagttacattagtacatagaaaagagaaattctttattttttttgcaacaatatatcttttttataaattctattgcttagtttattttaaatctttatgattgaagataggtgatgaaaatgattaaagcgatatttttagatattgatggaacattgatttcagggaaaagaccttctataaaaaaagaagtgattgaaggattaaaacaagtaaggaaaaaaggaattcaattgtttatagccagtggaagacatatgttagagctagaagaattaaaacttgttgaacagtttgaatttgatggctatcttttattaaatggtggctattgtataatagattcacaaattatttatgataataaaatacctcaagaggatttaaaagaaattataaagattgtaaaagaaaataattatccttgtttatttattgaaagtaatcaaatgtatattactcatgtaaatcaaagagtcatagatgctcaagcgtctatttcaacaatgattccaccaataagtaatcaaatcaatatagacaacatttaccaagtagatccttatgtagatgaaaaaggaataaaagaaattataaaaaacaccaaacatgtcaaagtcacaaaatggcatgactatgcctatgatattgttcccaaaacaggtgggaaagcagcggctattcaagctgtttcaaaacattttggttatcaaaaagaagaattaatggcttttggtgatggacataatgatattgaaatgttagatgtcgtaggttatcctattgtgatggaaaatggcagtgatgaagtaaaacaacatgcatgttatatttgtgatgatgttgaaaaagaaggaattttaaaaggattaaaacattttaatcttattgactaagagaaaagagtatgagaagaaaagatagagaaattactgattttgatgaaatgatgaaaattattgcaaagtgtgatacttgtcgtttagcactatttgatgatgaatttccttatatcgttcctttaaactttggaacagatgtagaagaaggacaactttatctatattttcatagtgccaaagtaggaacaaaacttgatttaataagaaaaaataataaagtgacttttgaaatggattgtggacataacatcattatgtatgatgaaagaatgtcatgcacaatgggttatgaaagtgtcattggacatggtattgtagaatttgttgaagatgaaaataagattaatgcgttaaaaatcttaatgaggcattatcatgaagaagatttcaaattcaatgaaaaagtcgcaatgatgacagaagttttccgtgtaaaagtattagacatgacagggaaaagaagagataatattcatcctgaagaaaaagtaaaaagacatattacattagagtaaaaccttggcattgccaaggtttttaaaactgataaacatcttcacctaatagatttaaggcatttaaatcaataatttgataagtaccacgtttaattttctttatgtatttcttatctaaaaataattgaagaacacgttggagttgacgataactacaaccaatcaattcagcaacgactacaaaattatcttgaacaatataatctttatgagaaacaataaaataagccgctaatctattttcaacaggataatttaatgaaatagattgattttgagttgatttagaaagcttgctggcaagattttttgcgatggctttcataaagaaaacatcattcattaatatttcatgatatttagaaagggaaatagttgcacaaatacaatcttcataagcaatcacattattaataataggagattgagtgataaattctaaatcaccaataatagagtagggactattaaaactgcataacatactatttccattcgcattaatatggtttactttcacttttcctcttaaaagaatataaatataattaagcttttcaccttgatgtaataaatattcgtctttatttaattttttgatttcaatatattgataattatcaacgtgaagaatttctaatttttttaattcatttaaataattcatctaaatcaccactacaaatatgacatatgtcgtatttataatcaagttcaatcactataattctttctggaggtgatcttgatggattttgtattagccacattatgtgggattattgtaacgacaatgaatgtatttaatgggcaattatcagattatacaggggtctatttatcaacagttatcattcatttagttggtttagttacttttttaattattatgaaaatcaaagataagaaagtttgttttaaaaaacaaattcctttatatatgtattgtggaggatgtattggggtattaactgttatttttaatgtttttgcgattggtaagataggagcttctttaatgacagcactaggattattaggacaaatgatgacatctttgttgttagaaaataagggatggctagcgacatctattcgaaaattaaatataggaaagatcataggattagcagttgtttgtttaggaataggagtgatgttattatgatttctattatattttctattctatcaggagttacaattgttttaagccgtagtgtcaatgggatgctttctaagaaaatgggtgcttatcaaggaacgttttataattactttacaggctttatgacaagtttgattttaatgcttgtgcttatgattgttggtgttcaacatataaatatttctttagataaaacgaatttgatgatgtatttgggtggaatcataggggtttttaatatcttgattttaaatattattgttcctagaatatcacctgttattcttactttattaagttttattggacaacttgtcagtgggatggtgattgatgcttttgtatataacatgttttctatttcaaagattttaggatgtttgattgttattgctggtttagtgatttatcaattaagtgaagaaaaagcaaaaagaagatcagtttagatcttctttttgcttaatatgagtttttctttttctgatctttttaattgtttaatttgatactctctttttaaagcttcgcttttatgttcaaaagtttcaaaataaacaagttcgactggtcttcttgcctttgtatatttagcacctttaccagcgttatgggcttcaatacgcttttctaactgatttgtccaaccagtataaagtgtttgatcacgacatcttacgatataaacgtaattattttgttgttgagccaaagccaccatttctttcttcagtgacatcatcatcttcaacaattccaaattcaaagaaaataccttgaaccattccttgtcctgcttttaaagaaagagatttatcttcattactatcatttgtaagttttacaaacatatgaccttcattatcactattataataatcactatcaataatacctactgtattattaagttgtaaacgatatttaaatcctaaaccactacgaggatataaacctaatacccaaccattttcaatacgtacacgaatacctgtaggaattttaatagtttgtcttggctttaattcaaaatcaataggactatagaaatcatatccagctgatccttttgtggcgcgttttggaagttggatggaatgatagatttcttctacttctttttcattatattgaggaaatgaatccatgaaatcatttttaaattggttatatgatactttttcaaattttgcgatttttttcatattttttctcctttttacttttctattatagaataaaaatgaaaacaagaaaataaataatttcctcacttgacagagggggaggagattgttattatatgtgtaaattacaagatatagtattaaatactacataagatagttaaaagaggtaatgaatatgaaaagaacaaaattagatgatcgtgttttacctgtttatacaaagggtgaagaaatatttaatatggtaactcatattgtaggtggtgcgatgggaatagccgcattagttttatgtattatcttttgtcatgatggttatggcttattttcagggattgtttatggaatttcgatgattcttctttatacaatgtcagctatttatcatggtttatcacctaagcttaaagcaaagaaagttttccaaattatggatcattgcagtatctttgtattgattgcgggaacttacacaccggttttactttgttcaataagagaagttgatgctaaatgggcttggattttatttgcagtcatatggatcatgacagtgattggaattacattaaatgcaatcgatattaaaaaatatcaaactttttcaatgatttgttatttagtgatgggttggtgtattatttttaaaatcaatctcttaccacaagcaataggaatgaatggtatttggttacttgtttcaggaggacttgcttatacaattggtgttattttctatgtgttacaaaataagattaaatatatgcatagtatttggcatttatggattttagttggttctatcttacattttttatgtattattttgtatgttttataaaaatcataaatattaatttaatgaaatcctttgtttatatgaacattggattttttattttgtaaaaacgtaaaagaactataaaatcaatattatttgtgatagaatggattggacgtcgaattattttaagtaaaataattcgaaaaaaaagtatgggccaatagagcataaaagtatatattttttttttgattagttataatacatatacgaaataaaaataaggaggcatttggcgtgaaaataattaaaagaaatgggcaagaagcaatttttgatgaagtaaaaattaccaatgcaattattggtgctaataaagaagttgttgaaacagaaagactttctgaagaagaaatagataatattacaaatgacattaaatataaatgtcaaaaaatgaaaagagcattaagtgttgaagaaattcaaaacttagtagaagatgaattaatgaaattaaatgctttttctgttgccagaaagtatattacatatcgttttcaaagagcactagcaagacaatctaatacaactgatgatcaaattttaagtttgattgaatgtgcaaatgaagaagttaaacaagaaaactctaataaaaaccctacagtaaatagtgtacaaagagattatatggctggagaagttagtaaagatttaacaagaagaattttacttccagaagatattgtaaaagcacatgatgaaggattgattcatttccatgatgctgattatttctctcaacatatgcataactgtgatttagtaaatctagaagatatgttacaaaatggaacagttatttcagaaacaatgattgaaaaaccaaagagtttttctactgcatgtaatgtagctactcaaattattgctcaagtagcaagttctcaatatgggggacaaagtattacattatctcatttagcaccatttgttgatgtaagtagacaaaagtttagaaaagaagttaaagaagaatttgaaactattggtttagaattagatgatgaaaaaatcaatgctttagctgaagaacgtttgaaaaaagaaattactaaaggggtacaaacaattcaatatcaagttgttactttaatgacaacaaatggacaagcaccatttattactgtcttcatgtatttaaatgaagtacctgaaggacgtttaagagatgaccttgctatgattattgaagaaacacttaaacaaagaatgaaaggtgttaaaaatgaaaaaggtgtttatattacaccagcattccctaaattaatctatgctttacaagaaaacaatattgaacctaatagtcaatattattatttaacagaacttgctgcaagatgttcagcaaaacgtttagttcctgattatatttctgaaaaagtaatgaaagaattaaaagttgatcaaaatggaaatggtcaatgttacccatcaatgggatgtagatcttttttaacaccatatattgatgaaaatggtaaaccaaaatattatggacgatttaatcagggtgttgtgacaatcaacttagttgatgtggcttgttcatcaaaaagagatatgaacaaattctggcaaatatttgatgaaagattagaattatgttatagagctttaatgtgtagacatgaacgtttaaaaggaacacctagtgatgtagctcctattttatggcaacatggagcattggctcgtcttaaaaaaggtgaaacaattgataaattattatacggtgggtattcaacaatttctcttggatatgctggattatatgaatgtgttaaatatatgacaggtaaatcacatacagatccaagtgcaacaccatttgctattgaagtgatgcaacatttaaatgatgcatgtacaaaatggaaagaaaaagaaaatattgatttctcactttatggaacaccaattgaatcaacaacttataaatttgcgaaatgtttacaaaaacgttttggtaaaattgaaggtgttacagataaaaactatattacaaacagttatcatatccatgtaacagaacatattaacgcctttgataaattaacatttgaatctcaattccaaaaattatcaccaggtggagctatttcttatgtagaggttccagatatgcaagataatattgatgcggtattagcagttatgaaacatatttataataatattatgtatgctgaattaaatacaaagagtgattattgtatggcttgtggatatgatggagaaatccaaattgaaaaagatgaaaatggtaaacttatttgggtatgtccaaactgtggaaataaaaaccaagatatgatgtctgttgctagacgtacatgtggttatattggaactcaattctggaatcaaggaagaacacaagaaatcaaagaacgtgtattacacttatagagatgaaattttcatctcttttttttatatttattaaccaaaaaccaaagaatggaaaatggtaaacaagttgttgatggaaatcttgaaggtattaaaaaatctttagaaggttctcttaaaagattaaaaacagattatattgatttgtattatttacatcgcgttgatcctaatgtaccaattgaagatattgcgtatttaatgaaggattttattaaacaagggaaaatcaaacattgggagatatcagaagcagaaattgaaatcaagcccatgcaatatgtcctttaacagccgtagagagtgaatattcaatgatgtggagagaaccagaagataagcttattcctttacttgaaaaactaggtattggttttgtaccttttgctccattatgtaaaggatttttaagtgatgcttatgataaaaatagttttcatgtaaaattaaatgcaccaagatttagtgaagaagcgcttaaaaagaatcaagtagttgttgatttagttaataaaattgcaaaagaaaaaaaggtaacagttgcacaaatttctttggcttgggtattagtacaaaaagattttattgtacctattccaggaacaacaaagttggaaagattaaaagaaaatattaaagcaaccgaaatcaaatttacaaaagtagaagctgaatcaatgaatgaagcattatctcaaatggatatcgaaagtagaagatttgaaccaaattcagattttgaaaaaagagttggtttataaaggcgagatattctcgctttttttattatgaaaaaaatttaatgaattgataaatttgtaaaaatatgtcgattatatccaaaaaatatgtaatactgaaagaagtgaggaaaggagaataaggtgaaagacatttatttattactaacaaaatcagatacttttgtttctaaagcaatttatttaatgacgcaagacagttatacacatatttctatctcttttgaagaaaatttacaaccgatgtatagttgtgctagaaaatatacttactctccaattcctgcaggaattagaaatgagtcatttgaaaagggattctataataaaaatcaacatattccttgtgcattatataaacttactgttaagaaagagatatattataaggcaaaatttattttagaatctattttaaatcattctcaagattataaatataatttaatgggattgatcttatgtaaattggaagttccatatcgtagaaatcattattatttctgttcagaatttgtaagtgaaatcttggcttatagtcaagctatagaattacctaagcttccttgtttaatgaaaccatcggattatttattatttgaagaattagagtgtttatatcaaggaaatattggagaacttataaaatatagagatttatgttaaaggatgatacatcctttttattatatcaatagaatctataaagaattgttgtataataggaaaatatgaaaagaggaattgaaatgaattatgcagaaattaagaattttgatatcgctaatggcttaggagttagagtttctttatttgtatcaggatgcacgcatcactgtaagaattgttttaatcaaatgacatgggattttaaatatggaaaagagtttaatcaagaagtagaagatttaattatagattatttaaaaccagaacatataacaggattgtctttacttggaggagaaccaatggaaccaagtaatcaaagagtgttattaccatttattaaaagagtgaaagaactttatccacaaaaggatatttggtgttatacaggttatctctttgatcaagaacttttaagtgaaagtcgagcaagatgtgaagtaactgatgaattgttatcttatatcgatgttctagtagatggtaagtttattgaagaacttaaagatttaagtttaaagtttagaggatcgtctaatcaaagaattatagatgttaaacaaagtttagaaaaagatgaaattattttatataaagatttgaatgaaaatagaaattttcaaaaatatgaataagacgatatacactacataattagataaaattatgctataatgttttcgttaattatagagggagtagaatatgataggattttatagttacactgtcattcttacatatttatcattagtttttgcgatggtaggaattcacttatctgtcataggtgtttatcaatggtcatttatttgtttaatgatgtgtggtatttgtgatacttttgatggaatggtagcaagaagtaagaagaatcgtacagaggaagaaaagaaatttggtattcaaatagattctttgtgtgatcttatttcttttggtgtgtttccagcaatactaggatataatttaggattatcttcagtaggatggcttgctattgaaatactttatgtattagcagcagttattcgtttagcttattttaatgttactgaagaaacaagacagcaacaaacaacagaaaaaagaaagtattatcaaggtttaccagttacaacttcagcctttattttaccttttgcatttgctttaagatatgttatttttggtttagattacttatatggaactttaatgttaattacaggtattttatttgttgttgattttaaagtgccaaaattaaaagggaaaggacttattgcacttggtgttctagttgttgtagaacttgtgcaaattctttgtttttcatgattaaagatcgtcaaggacatatcgttaaagaattagagggtcaaaataaattattaaaaaaattatatagcacatctgctggtagatgtgctttaaaaatcttagtatcaccatttgttacgcacttaggtggtttatatatgtcttcaccattttcaaagacaagtatttcttcgtttattaaaaataatgatattgatatgagtcaatatgaagaaaagaaatataaaagttataacgatttctttacaagaagaataaaggatggtcaaagaccatttgacgactctaaagatgtattgatggcacctgctgatagtaaacttacttattatccaataaatgatgatacgattttagaaatcaaggatacaaaataccaattaaaagatttattacaagatgaaacattagctaaagaatatgatggtggaatatgtcttgtatttcgtttagctgttgatgattatcatcgttatagttatgtagatgatggtcaaattgtttcccataagaaaatcaaaggtatttttcatactgttaatcctatcgcaaatgattattatcctatatacaaaatgaatagtagagagtacactgtgattgattcaaataactttggtagaatgattcaaatggaagtaggagcaatgatggttggtaaaattgtcaattataaacatagtattgctactaaaggagaagaaaaaggttattttgaatttggtggatcaacagttgtattgattttgaaaaaagatactgtcaaaatagatgatgatattataaataattctagtgagaacattgaaacaagagtattactaggacaaacgataggacataaaggggtgtaaagatgtcgaaggttatagcaattacaaatcaaaagggtggcgttggtaaaacaacgacaagcgttaatttatcagctgcacttgcgaagatgaattataaagtgttacttatagatatggatcctcaagcaaatgcaacacaaggtattggtatcgatagagattatattgaattatcaacatatcatgttttaacaggagaagttggtttagaaaaagtaattcaacattcttatattgaaaatctagatgttgcaccaggagaaatagatttagcggggatagatttagaattagcacatgtaaaacaaggaagagaagtgcgtttaaaacaatcattagataaaattaaagattattatgactttgtttttattgattgtccaccagcccttggtttattaaatacaaatgcattaacttcatgtgatacagtacttatcccagtacaatgtgaatactatgcacttgaaggtttaacacaattgttaaatacaattaaattaacacaaaatcattttaataaaaaactttctattgaaggtttattattaacaatgttagatcaacgtacaaatttaggattggaagtttctcaagaagtaagaaagtattttaaagaaaaagtttataaaactgttattccaagaaatattaaattatctgaagcaccaagtgcaggaatctgtatttttgattatgatggatcttctgttggggctcaagcttataaagaacttgcaaaggaagtgttgagtagaaatggctgagaaaaagaaaaaattaaataaaggattagatgctatttttggtggagatattacatcattaattgatgatattgaacataatacacctgaaagtagtcaagaaaaaatcaaattagatgaaattagacctaatccttatcaaccaagaaaagtatttgatgaacaagctttaaatgaacttgctttatcaattcaagaacatggtattttccaaccagttattttaaagaaatctgttcaaggatatgaaattgttgctggtgaaagaagatgtcgtgcagctagaatggcacatttagaagaagttccagcaattattgttgattttagtgatcaacaaatgatggaaattgctttattagaaaatattcaaagagaagatttaaatgccatcgaagaagcacaagcttatcaaacgatgatggaaaaacttaaacttacacaaaatgaattagctaaacgtattggaaaatcaagaacacatattacaaatacacttagattattgaatttacctgaaaagattcaagaatatgtattagatggttctttatcaatgggacatgcaagagctttaattacattggataaagaaagagcattaaagattgctaaaagagttattgatgaaaagttatctgttagagatgttgaaaatattgtaaaaggttttgaacttcaagaagccagaaaaaataaacctaaggttgaaaaacctaaagaatatcaatatgttgaaggattacttagaaaaaaatatcgtacaagaattaaagttgatgataaatctattacaattaaatactctgacacagatgatttaaatagattattagaattaatgggtgttattgaagaaagctaaacttggttaaaaaccaagttttttctatgcaacaaagttatagtagattgcaaaattgatattgtacatttagacttctttatttcaaaatataagtaagaaaagaggtcatattatggaatatcaaacattaaataacggattaaaaattcctacaattggatttggtgtctttagagtaccagataaaaaagaatgtgaagaatcagtatatcaagcaattaaagcaggatatcgtttaattgatacggctgcctcttataccaatgaagatgcggttggtgcaggcgttaaaagagcaattgctgaaggaatttgcacaagagaagatttatttattacttctaaaatgtgggttcaagatatgcaaaattatgaaatgactaaacaagcaattgatgcttctattgaaaaaagtggtttaggttatttagatttatatttgttacatcaagcgatgggagattattttagtgcctggagggccatggaagatgcgtataaagaaggtaagttaaaagcaattggtgtttcaaacttttatgcacatattcttgttaactttgtccatacagtagaaattaaaccaatggtcaatcaagtagaacttcatccatattacacacaagaaaaagttctagaaacaatgaaatattataatgttgttcctgaagcatgggcaccactaggtggaggaagatataatccatttgaagatgaaatgttaaaaagaattgcaactaggttttatatttggcatattctctcctccttttattaaagtcattatactattttgacacctgttgctaaaatatcagtagtatttgttattccaacggtatctaatgctgtcaaataatccgaatattttgaatctaaaatatttgacattgatccaaagaattcataagcaactgcatattttccacctttttctttataattttttattccatttgtacaagtcctaaatgctttataaatagcgacacctgtttgagctttataaaattgttcataagcatctatatcattttgtgaaataatatttgcatatacaggatgtccaaaatttttttcatctgaaaaactcttatcatagtttatattttcaatataatgtgaagtatataaatatatcgtatatatagattcatcatggtttccatcattatattctttattatagactgatcgaatatacttcattctttctttttgtccctctttagatgcaggtggatttccatcatatggatctccacttcgtgatgattgtatattaactttttttggtatagatgtatcaaataaatcatttttatctaaagatatagcgtctaataattcatcatccgtttgagttagcgtaattaaattcaataattgtcctgatgtaacaccagctgaattatatttatctgaaatatcaattatttaatcagtcacttcatctaatgtaatttcatcttctgcatttactgttggaatagttgttaatatcataccagctgcaataattccaataaatacttttttaatcataagctttctccttccttttcacttaatcaacatctaaactaaataatgtaaactgattataattattaaacttgatatctacttcttgattattttttaatataactctgtatttattttcttcaccaatttcatatgaatctattttcccaactaggttttcaattactgtaaaatcatctttgatgctttcatgacttttcatcataaaagttgcatatcccttatttcgacgaacgagcgaatactcttttgtttccaaaacattacacgaacccacgtagtcagcttggaaggctgaagttctaccattgaactacacccgcaagtatggtgcccgaaaccggactcgaaccggtacagctgttacaccggcagattttgagtctgctgcgtctaccaatttcgccattcgggcttgtgtgccttatcattataacaagacctttattataaaacaagcaaaaaataaaaaaagagtattccctactctaatttatctttaaaatcattccatttttcttctgtgaaattttttacacgatcaatcccattttctacatcatctacagcatcttgaaaaataccttccccatttccataataatgcatcatcaatgttttcgttttctttcctaattccaaaatttctttttcttcacttgataacttttgatctgtatttttttctatatactctaatcgactcgcagctgcgtaaacttttttagcttcttcttgattatcttgagtaattccttcttttattttatcataaccatctaaaattgtttgtgttaaggctttaacatcttgtttagaagtatcattttcaacatcttgatctatttgatcaaaatcatcctttacatcatcccacgcaatttctacgtttcctttaaaaccactatcagttgtttgatttctacagcctgttaaagtaaaagtacaagttattaaaagtatcaaagttataatatatcttttcattttattccttctttcatttctagtatgtccttgatattttatttcatacttttattgaagaaaaagcatgttttcgataaaatataaaaaaagaggaatgcttatgacaaataaagaaagatttatagaattatataaaacaaatataaaaagacctggaagtgaaaaacttcttgaatatttattatctccacattctgatttctttgaagcacctgccagtgcacgatttcatggaagctatgatggtggattacttgaacatagcttaaatgtttatgattgtttgaaagattatcttcaaagagaaagagtgaaagatacatatcaaatgaattatagtgaagaaacaattgcgattgtttcattattacatgatttatgtaaaattaactgttataaaaagggaacacgtaatgttaaaaaagatggtcaatggattcaagtaccaaactatgaatatgatgatcaattgccttatggtcatggtgaaaaaagtgtttatatgattagtggttatatgcgtcttacaagagaagaagcttttgcgattagatatcatatgggcttttctggaaatgaagatgctagaaatgttggaaaagcttttgaaatgtttcctattgcttttgcattaagtgttgccgatatggaagcaacttattttattgaggggaaaaaataatgaatgaattgtttattaaacgaatgaaagaattattaaaagatgattttgatgcttttattaattctttaaatgagaatgaagttaaaggattttatttaaatcctttaaaaaaggatgttttaaatcatttaaatcatcaatatatagaaaaacatccttatgtagatggtggttattattttgattatcttcattatccactaggtaaaagtccttattttttgtgtggactttattatattcaagaaccaagtgctatgagcgtagccgcttgtttagatattaaagaaaatgattatgttttagatatgtgtggtgctcctggaggtaagacgtgttatgttgccagccgtctttctaatgaaggattaatgattgctaacgatatttctaaattacgtgcttctattttatcaagtaatattgaaagatttggtttaaaaaatacaattgtgacgaattgtgatcctttaaaaatgaagtttgaaagtttctttgataaaatcattttagatgctccttgttctggagaaggtatgtttagaaaagataaagaagcaattgatacttggtcaatgcaaaagataaatgagtgtgcttatattcaaagaaacttaattgatcaagcatataagatgcttaaaaaagatggcattttaatttattctacatgtacttattctttagatgaaaatgaaaaacaagttgaatatatgatcaatgaattaggtatgaaattacttccaattaataaaaaagaaggaatgtctgatggttttattgaaggaaccattagaatgtatcctcacattaatcgtggtgaaggacaatttatagccatgttacaaaaaacaacagaaacagctatttcaaaagaaaaaattttaaaaccaaatttaaagaaagaacagctacaacttgttcaaaagttttatcaagaaaacttaaatattcctgtaccaccttatctttatcaatcaaataatcatgtctatgctattttaaatcattttcctgaacttccaatcaaagttttaagaaatggtctttatttaggagaatgtaaaaaaggaagatttgaaccaagtctttcacttgctcttactttaaataaagatgatgttaaaagatcttataattttaaatgtgatagtcaagaagtaaaagattatctttctggtttaactttaaaaggaaataataataaaggatatggtattatttttgttgatggttatccactttctttctataaagaaagtaataatcaagttaaaaatttatatcctaaaggacttagacgatgaaaagatatttagaaattgaaaaaatcgtatatcaagaacttgaaaaaaactgttttggaaacaaaaaaagacaaggctatcgtcatctatttggcgtttcaaccttatgtattgcctatagtcagtatgtacaattagactgtgaactatgcgctattatgggacttttacatgattattccgtttataaaaacaatacctcatttaatcacgctcaactttcaagtgaacttgctagaaagatgttagaagaaagtttattgtttgaaaatgaagaaataaatattatcgttcaagctattaaaaatcattcaactaaaaataaagttcatgatcaatatagtgaactacttaaaatgtgtgatgttttagaaacttattatcatgatcctgattgtatttttaatgaatatcatcaaaaatatattgaaaaagcatcattacttcttaacaaataaaaaaacttaatgattctttatttcagactgttgacatataaaaaaacaacagtcttttcttttgtaaaataaaaagacattaaaaatagaaattttaagtatctttataatacaattattctattataagaaacaattgtatctaattacaacaattcctcaactataacattcgaggaattaattagtagaaaatatatattattgataagagatcaatattctattttttagttagaatttataacaaaaaaggatgttacgattttaaattatttcgtaacatcccctttattttaattcttctaatataattttagcaatctttttgttatgaataatataactgctatgatcttctccttcgagaattctaaactcacagtttttaatatgatgtgaaatacgttcaatatgatctaatttaattaaatcatcacttcctgcaagcagtaatgttttagcttctatttgatgaagttgttgattagaaatatggggttcttctaacatcattctaattaaaggattttttgttttttgatattgctccttcatttcttgataaacttctaatataacaccattgggtttaacattgactcctgcaagaattaaatgatctacaagttttggataaagacttcctattaataaaccaataattgctccatcactacttcccattaaagaaatatcttttagttcaagttgttcaatcatttcttgaatatcctttgccatatctagataatgatattctagaactttatcactttgaccatgtcctctagaatcaacagcataaacagtataatgcttttttaataattctatagcttcatcaaaaatacgatgatcttcttcatttccatgaagtaaaattaaaggtttccctgttccttgtttttcataaaacaagcgcacaccatttacatgtataaacattaacaatactcatccatacacgcttgaattctactttgaacaagagcagcaatttcaggtgtttttaaatctttatattcatcatattcaattggttttaaataatgaatttgtgcttttacgggtttaattgtattgttatcaaatacttgataacaatcaatcattgctactggaacaattggacaatgagattttaaagcaattttaaaggttccacctttaaattcacctattttattaccttgtttagaacgtgttccttctggataaataacataattcataccagcttctatttctttagaaacgtttttaaccattttggcaccatctctaatattactacgatctaaagcataatagtctaatgttttaacaacatctttaattaaaattgtagatgctaattctttttttaatacaaatttagctgttttatcatgtgttttaaaaacagccacaatatcaaataatccttgatgattaggagtaatgagatatccattttcttgaggaagattttctaaaccataacattctaaatctactcttgcttttttaacaatttcatcagcaacattatgtataaattgatatccttcatcaattgttggatatttttctttattttgatattgttttaacttataaaaccaccaataaggtaatttaaaaatacatcttaagacaactaaaattattcttttcatatcatcatccctttttatagatttgtaagacaaacgtttccatttgtgtttctttttctaattgaaaattatattcgtcaaaacttggaaaataggtttcaccttcatgttttcctggtattctagaaatcattagttcatctacataaggaagtgcttgcttataaatagaagcccctccacaaataaataaatcttcctttttatttttatattcttgaatcgtttccactaaatcatgtcttacttctacacgttcatcatctaattcaccacgggttacaacaattgtttttctatgaggaagtggtcttcctattgccatgtatgttgtttttcccattaaaattgtttggtgaagtgttgtttttttaaaatgttgtaaatcttctttattatgccaaggcattccattagaagagtcttttttaccaattaataaatcatcatctgttgctacaataatagaaatcattagacactcacctttccaacaagtctaccatgagattgataattttcaattttaatatcatctattgtaaaatcaaaaatagatttaacttctggatttaaaacaagttgacatttaggataaggagttctagaaatttgttccttaacaacatcaaaatgatctttataaatatgagcatctcctatagtatgcacaaactcttttggtttgtacccacatacttgagcaagcattgctgtaaataaagcgtaagatgcaatattaaatggtactcctaaaaatgtatctgcacttctttgatataattgacaacttaaatattttttatcattgcttacataaaattgtaagaaagcatgacatggtggaagtgccatttcatcaacttctgctggattccaggcacaaataatatgtcttcttgaaaatggattattttttaatgaatcaacaagttttgctacttgatcaataccttcattattaaaattacgccattgtctaccataaactggtcctaattcaccatatttaacaacaaatggatcatctgctggtaattctttgattttagcaacaaattcttctaaagtttctccatgaaaatcttcacttttcttaaaagcttcataaggccattcattccaaatcttcacatttctatcaacaagatattttatattagtatctcctttaataaaccataataattcttcagcaataggtcttaaaaacattttctttgttgtaagtaaaggaaaaccatctgttaaatcataacgtgtttgataaccaaaaacactacgtgttcctgttcctgtacgatcatctctatcttgaccattttctaatatatattgacacatatctaaatattgtttcatttcattcacctctctttgtcaattatatagaaaatcatttcaattgtcatctacaaaaaaagaggatttctcctcttaatcatatctatgtcgatattcttccatcattcctttaaagatttcaccatttgtaggtggtgtaaaggttacagcatttgctcctgcttgaataacttctctaactgtttcttctgttggtccaccagtagcaataatagggaaattaggatcaatttctcttaattttttaacaattttaacagtatcttttcctccagatacatttataatatttgctttcgtatgtaacattcttttttctaaatcttcatttaaagaaacaattgttaaaacaacaggaatatcaatatcatctgcaagattttgaacaaattcagttgctgttggtgcatttaaaacaacagctgttgctccatgtaactctgcatctaaagcaatcgattcaacacgtttaccggcagttgttccaccaccaacaccaacaaaaacaggtctttgagcaactgaaataattgcttctgtaatttgaattgttggtgtaaaaggataaaccgcaataacagcatccgcattacaattagcaatcaccgctacatctgttgaaaaaaccagtgatttaattctttttccattaattaaaactcctgtagcttcacgataaacttcaggtacaagaattgtatgacttctcagttgtgtattaattttaggtattgctttattcataaaatcctccttaatgtctttgaatataatgatatgttgctccaattaaattcgcatcatttccaaattgacatactttaatatttggtcgtacatgtgcatgcgttaattgagaaaaaataatatctaattgttcattgactttatctaataaatcacttcttgatgaaatagctccaccaataataatcatgcttggatcataagcatattgtaaattataaatacccattgcaagagtacgataatattcatcaacatattttttataaacttcattattatccgcttgatcaaaaacttctttaccatctaaagtatgataatcaacgtctagttccttagccactcttttagttaccgcaactgttgatccatcatctgaccatgtataatatttcttttcatcttgatcatatctcataatcatataaccaaattctccaccatgtaatgcatttccatgatgaacatgacgatctttaataactgctccaccaattcctgttccactaacaataaaacagcaatcattttcatgacatgcaacacctttccatacttctgcaagggctgcacagttagcatcattttcaaattcaacatctttatttaaacgttgttttaaatcttccttaatatttggaccatgaatataatcgatagcacttgaaccataaataataccaccatcactatcaacagctcctggcattgataaagcaattccttctatatcttgatattcatgagctacattttctatttcttgatacattttttctaatgtatctggtgttttaaatttatttgatgaagacacttctccttcttcatttacaacagcatatttgacagatgttcccccaacatcaaacgctaaatattttttcataagcctctcctttcgtttcttacattattatagtatatttttttgaacaaatcattaacatccttattttataaacaccttattccattcatcacaatttctttccaataattcaaaatcaaccgttgctaattttatataattataagaagattttctttttttcagtttataaacaatttgtgctcgtctcaatatatcctcttgatttttaaaacttcttaaaacctgaacttgatctattaataatcccttatactttaaatctttttctaaaaaaatattaaactcatgataacatccttcaggaacaggaatcatattattaaataataactttcctagatatgattcaaccgttggatttccattaaatattcttttaatagttggaactcgtgtaaattgaacttttttatgaccatcttgatcattaaaataatctcttttatcaggtgaagataagggaacaaaatacttataaccatttattaatacttttatagcaataaattttctttgatgatttccactattatgtattaaaacttttgaatctgctttgtataaatattccatatattgactatcaatttcatataatttcataaatatagctccttttagataataaaaaaacgaagaggttatctcttcgtataagtatttgatttcttataagaaatctatgattttttagctcccactatttggcagggaatctcctgattttttagctcccacttttttatctttttctatctttccctctttttctgcctttatatcaacgttttttatcatactctttttttaccttttctctcttctttgtctaatatactgtgtttttacagcaaaagaagacctttttagtagccttctttcaaactgttaacaaataaaatgttaatagtctgaaggacctatttcctcaataggcccttatttttgaataaacttttgatcttctttttgaataaacttttgatcttcttttggtattcctgtttcatctaaaaaataacgttcaactttcatatgtagatgatatttgattcttagttccgttatttgatccatgatactagaagcatgatgtaaatcaattgctgcttgattatcccaactatccactaataaaaccgtttcttcagcttctactgaaaagaaatattcataacgtctatttcctttttattttctaatttcatcaacaagaccacttgttaacatctctttgacaaaagctttcgcacttccattttctccagtatagtaaatatgaacagtaattgcgttattctttttcaaggcttaatttcaaactttcaatacgttgattgatttcatcaatcttttgaacaactggagcagctttttcatcaaagacattgtccttgtttaaaacttcataatacaactttcctaattcaatgaattgatcatccaaatcagcttctgcacttttaatacttactttcgtttttgcagtatctgcaagttcagaagatttttcaattgttttttccgtaaactttaccgctttttttgttaagtcatcaaataatgccatacttttcccttctttctttccataattttatcatattgacctttataattaaacatttataattaagactgtttggaggtatttatgaatcatcgattagaaaatgaaaaagtgtcatcacttttattctcgctcgctttaccatccattttggcacagcttgcaacacttatttataatatggttgatcgtatttatattggtagacttcccgatggtggtttatccattgcaggaattggtttatgtacatcaattattacaatcattactgcttttagtaatctttttggtcgaggtggtgctccacttgcctctattaaattaggagaaaagaaccccaaagaagctgaaagaattttaggaaatgcgtttagtagtttaattttgacctctcttataattatgttttgtcttttggtttggggtgataaaattcttattctttttggagcaagtcaaaaaacacttcattatgctttatcttatttaagaatttatgcagttggaactgtgtttatccaattaacagtcggtcttaattattttatcaacactcaaggttatgcgaagtttggcatgatgactttacttattggtggtattttaaatattattttagatcctatctttatctatgttttacatatgaatgttgctggtgctgcccttgcaaccattatttcacaattcgtctcatgtatttgggtgttatcttttttatttggtaaaaagacaattataaaaataagaaaagaatatcttttatttgataaaaatattatgaaaaagatattaggtttaggttttactcctttctttatgtcatcaacagaaggaattttacaagtcgcctttaatagacagcttcttctttatggtggagatttatcggtaagtgctatgacaatacttctttcaatgtcacaaatcctatctcttcctatggaaggaattgcccaaggagcacaacctattattagttacaattttggcgcaaaaaaatatgatcgtgtaaaagagactattaaaattacgatcaaagtagctttaacctattcaattattggtgttttattaatggaggccttccctcaagtatttgtttccttatttgctaataatactcagttaattcaactttcttatcaattattaagaatctatatctttggctttattatcatgggtgctttctctacttttcaacaaacctataatgcattaggttgtggaaaaaatgcatttttctttgcattctttagaaaaatcattttattaatacctttgatttatctgttaccatttattttaccaagttatggagtttatgctgttgttttagcagagccaatttcagatttaatgacaacaattcttaatggtgtttatttcaagcattttgtgaaaaaaacacttgcttaaaaagaggctacaaaagcctcttttactctaattaaaaatatcttttttacctttaagttcattatttatgattgaaagtatttttctatttctttaatttctttttctggtatttctaataagcaaaccgcttctttaaatgacatttgtaatctttccattagttttcttacatactctatattcttttctttacgttctatttttttgccttggttgattccttgactaattccttggctgattccttcatttcttgcttttctttcaagatagtttgcataatcacacatttctttgacctccctttctgtttccttaaatccatatcctttaataatagaaaaatgaaaagcgatcctttaacaggacctctctatattggaacagcgcaaacagataatttaagtgaaattgtgaaaatgatgaaactctttcaagaacgttatcctcatgtacaatttcatttattaagtgatgataaagaaaaattattaaaacaattagaaagaaatcttcttgattttggtctttttattcatgattacgatagaaatctttatgaaggaattcctttaaagagtacaaattctttagatattcttgcttttaaagtacatcccttcgcttctaaaaaaatcattgcagaaaaagatcttaaagatgaaaaaataatggtcgctagacaagccatgcaaaatcaagaaatacctgattttattgataacaaacaaattgtcgctatttttgatttaccagaaaacgtaaaaataatggttaaagaaaacatacctttatatcattggcaccttattaaaaaaaagaaacctacttctttattacaaaaaaattttatagaaatactaaaaagcgagtactaaccaagtattcgctttaataatttcgatttttctataaatttttgacaatgctttttataaagggcatgttgttttacacaatctctaatacgatttgatgatttcattaaacaaattgctccaataataaagaatggaacttgaggagcaattggaagcaataaaccaacgaatcctaataaaataaagaatagtccaataataaataaaacactttggtagatgtaacgtaacttcatagatgcctccttttgttaaaaaaagcataaaaaagttatatgaacaagccgtgaactatttctaaagaaaaaccaaataattctaaaagaaaaattatttttttaataatcgcaataagtcctttggttgtttgaaaaccaaagtggctggtatttcttgcgtagcaacactaccccattttgcaagaccaaaatcaatgtgtgcgtttttagatgcttcataatccgattgtgcatctccaatataaataacttcttcaggttttaaatttaatttttcaatacattttaatagtggttccggatgaggtttatgaaaagtagtatcatcttgtaaaataacagcttccatgtattgatcaattcctttagaaacaatatcaatttcatattgttctctaagtttagaagagacaattgcttgtttgatttttttgtttttaaatgtttccaaaacttcttcaaatccttcaaataaagtagcaccatcttcatagtcatttacatattgcacccatctagcataggttttttcttgatctttaacacctaattcttccatgaccttcatacctggataggctgcaaattttaaaacctgttcaaaagtccaatcttctcctgtttcttctttaataattttcataagggggtacatattcatttttaaagtatctaaaagtgtaccatcaatatcataaataatcgctttatattttttcatctctttcaatcctttctttcaataaataaacaatacctcgataagccaatccctcaaataacatcgaagaaatatctttatgaaaataaagatttttaaaacaatttttatctattttatttaatatatttttaatgatcttttcttcataattccattttaaatctaatgacagttctaaacgcgttggatcaagcattgtaaaaatcatacttaccaataaccccagaagttcattaaattcatcttgactttgacattcacgaatgcgttgattaatcgtttttcctttaaaagatatcaagcctatttcacccatgattccagtatttccatatagcggttcatctttataaaaataagagcttcctattcccacttcatttatatatagataataagtagtgtcttgttgatacgtaaaataacatccttgatgaatcatcttgacatcattttggagttgaattggcagatctatttcttttttgatatctttcacccaatgatgtttttttagaatattttgatgatcagtaacgtattcatcttcataaacaattccttcaaccgctatttgacaacaatgaacttcatttttatctactaattgtcttattattttttttaattcttcttccccttgataaaataaagtatcttctttttttatttcactaaaacctcttacttgataaatgattttatccacttgaatataaagacatagaattaaataatttttttcatttaaggcaaaacgtgttggacatcttccgccacttgataagtcatttcctacttcttgaatcaattgtttttcttgaagtattcttaccatattacgaatacttggttgtgataattgaagatttcctactaattcgttcattgttgaactattatgaagatagagatattttaaaatagctaataaatgttttttcttcgtttcttttaatgcattcattatcctcacccccacttttattatactataataaaagtaaaataaaagaaaaaccagaatcatctggctttaggtttaaaataacgtgtcatatccacaccttcatgttttaataaagcaatttttttatcaataccacctgcatatcccgttaaactgccacttgtaccaacgacacgatgacacggaatgataattgaaataggattatgacctaccgcattccctacggcttgtcctgacattttttctttatgaagtttttgagctacaactttagcaatctttccataagttgtgacttcaccataaggtatttcacaaagaagtttccacacttcttgtctaaaaagacttccttgtggttttaaagaaagctctttaatatctggtttttctcctttaaaataacgctctaaccaacttttggtttcttggagtatttttatttgatcgttaatgataggctcttcttttaatgttgcttgaaaatatttttgtccttcaagccacaatcctattaaattttcttcatcacttactaaatataaaattcctaagggtgatttatatgttgttttataatacataatcttttctcctaaatgtcttttaaattattttgacgatgattaaaaagttatttttgatagtgttttggtttgacactccccatgtctaaagacaggggattcttgctacctgccaacattgttatagattatagaataaaggaagcgatacaaatgcatgacaaatatatatcttctgaagaatcatacctagaatatcttgatcgtttagataatgaaatattgcttcgttctcgtgatagaaaaattaaagaagcgaatcaaaaagtcgaggaagaaaagcaaaaagctgaagaagcgaatcaaaaagccgagaaagagaagaaaaaagccgagaaagagaagaaaaaagcggaggaagcaaaccaaagagctgaaaaagcaaataacgaaatagatagtattcttgatgaaacaaaggaaagtattattaagtatattaaaatgcaatttcatgaagatatcagtgattttataagcactttttctaaacaacaaattcgtaatcttcaaaaacatctatatgattttgaagaatttgaagaattaaaaaattattttcaaaaaccaaagggtttgtcaagaaaagtgtgtaagtaattgggtttgtcaagaaaagtgtgtaagtaatttaaacattactaaaaaataggttattcaagtttgtgattatttcttgtagtgtcactaaaagaacttgtatttaataagcagcagtgttaaaacttatctttaatactgctgttttttgagtatataaaaggttatgcaatatatgaataattgcatccttctcaaatcaaaagaataagcagactcgcttattctttttaactatcttattaattgtcttaattctccaacatcaagagaatatctttctgctaccatacgatttacttttccagtatttactaaagtagcaagtgatgcatttaatgttgtcattccttcatttcttccagtttgaatcattgtctctatttgatgacctttattttccctaattaaatttttaatagcgtcattagcaatcatgatttctaaagcagctgctcttcctttaccacttgcaagtggtaaaagttgttgagtaacaaccgcttgtaaaacagaggctaattgagcacgaatttgagcttgtttatgaggagggaaaacatcaataatacgatcaattgttttaggagcaccaatagtatgaagcgtactaaatacaagatggcctgtttcagctaaagtaataactgcttgaatcgtttcatagtctctcatttctccaacaagaataacatctggatcttcacgcatggcactttttaaagctgtatcaaaagaatcaacgtcttcatagacttccctttgatgaataagagcttgtttttgttgatatacatattcaattggatcttcaatggtaagaatatgacaatttctcattgaagaaataaaatcaatcattgctgctaaagttgttgattttccacttcctgtaggaccggttactagaacaagtcctcgaggaagtaaagccaatttatgtaaaacatcaggtaaatttaattcttctaatgtcttgatttgttcattgatgatacgaattgcggctgtcatataaccttgttgaaaataaatattaacacgatgtcttcctaaatcatttacatagacaaagtcagcatcttcatgtttttctacaatctttaaaattcgatctttacacattgataaaatcatttcttttatttcttcattactaaaagtttgttcaaattcaataagttttccatcttgtctcaatgttatacctgtattttcaccaatatgaacatcactacatcctttaattcttgcatcatttaaaatatcattaatatttgccataacattcccctttaatcaatataagcaataatcttattgaattcatctactgttgttttaccttctttaactagttttaaagcttgatctcttaaagtttctactccttgttcttcaacaagatatttcataatatcatctatttcttcttgattagaaatcattttacgtactttactatctatttcaataacttcatgaatagcaattctccccttataacctgtttgattacaatgaggacagcctgttcctttagatatatatttgattccttcttgtaaagctaaacgatcagataatgaagtagctacttcctttttacaataaggacaaacctttcgcattaaacgttgagcaacaacacctactaaactgttagcaaccatataaggttcaacacccatttcttcaagcctaacaatcgtactaatagcatcgttcgtatgtaatgtactgacaaccaaatgtcctgtaatagctgcacgaacagaaatttcagcagtttctttatcacgcgtttctccaaccatgattacatctggatcttgtctcattaaagcacgcaatcctctatcaaatgtaagaccagacattgtattgacttgcatttgattaatacgatttaattttctttccacaggatcttcaatcgttgaaatattgatttgtccttgagctaatttttcaaggatcatataaagtgttgtagttttcccacttccagtaggacccgttacatagataattccatgtggcatagacatcatatgattcattttattaaagttttcttctgtcattccaaaagtacttaagcggtcaatagtactattagaattcaaataacgcataacaatcttttcaccaaagatagtaggaataacagatacacgaatatttaattcaactccatcaattactcccataaaatgaccatcttgaggtaatcttttttcagcaatatccatgttagataaaattttaattctaacaatcaaagccgcttgtatatttttatttaaatctaaataatcaacaagcattccatcaatacgcattcttacatgcaatttttcttcaaatggttcaatatgaatatcagaagcactattattatatcctctaattaacaatgaatttaataatttaacaacaggtgtatcatcttcattcgcatcaaataaatttagatcctcttctacttcaggtaaagtcgattcatcaatatcatctactaaattcaaagtatcaacatccgaataatacctttctattgcaatagaaatatcagatttagtagctaaagaaacactaatacgacaaccagaaacaagtcttacatcttctaacccataataattcaaaggatcacttgtcgctactgttaacacattatcattaaaagcatacccaatgacattatatttttgtgccattgcttcaggaatctttttaactgcattaatatcaaaatctatattttctaatgaaactaaaggctcagctaatttatcagataaagcttccaacatttgttgttcacttacaaaacctaaatctattaaatgttcccctaatcttttacttctatctttcttttgggcatctaatgcaatctgtaactgttcttcattaatatacccatattcttttaatacttcacctattggtaaacttttcatgcgtaaacctccatcaatttactgtactccaaaaataatttggatttggattaccattaacaatttctaacatatgtggccatgttgttggattattatctttatttatattttgcatggctttaagatatcctaaatcttgagcttcagaatataaaacaatatcaccctttaagtatgcactatttttattccagtcacgagataaaatttgccatccagaagatgcacttgatccaggacctccagatccatccaatactttcaaataatattgtttaacaccgtttttttcttcattatatatataatcacctattttataatccgttttattaacatcatatttaggaatgctatttatttggctttccgtgagtcgatccaatttatttaaaactgtatcagttcttcttattgaaatatcatcacaattatgtacatcttttgtaaccgtatttttaggaccaatatacttccaataagtctgctttccattaaatccatctggcgcatatccatcagaactatcactgccaactcccatagaatacatatcctgtaagcattgataataacattgttctttttcaaaaaaaacaatatcacctttagtatatgcactgagtggactataatttttatctatctttttccaccatcttgctttacttttatcaggtgaagtagcattacttttatcttgaattaactgccaccatgacccatcacaataaacaaaatcacctttactataaataatgtcttccttctacataatcaccacgattatttttcgtattaatacattcaacctgtttagcaactgtgatttcactaccctctttctcattatcatcgctattattagacgaatcatcttttatataataaagttttgtattttctgataactgtgtcgtactagaaatattactaaataaagtcgttttatcagttgtattaatattaaaattgaccaactcatatgtattctttgttgaatatacttcttctgtcccatttaaatacttaagtgttaaatctaaacgatatccattagtggtaaaacctctaacatccatttgtaaatctcgattattaatataatagtcatcatcaaaaaccgctttaccatcacgataaagtctacctttatttttatcattttttaatacataaagataatgccaatctctatcatctggtttagtatttgatactcttacatctgttgcataggtgatttcattactaataaaatctagaacaccatctaatgtttgtttatctaaagatttcttggttgttgtatcaaaataacctaatgagttgactaagattccaccagtaattgtcataataatagaagcaattaaaagtacaacaacaatttcaactaacgtcatacctttattatttactttttttatcatcttagtcaccctcttttctattttgatgttgtataataaatccattcattaccacttattattttataaaactctgaatatgttttattttcaagtatttttgtacttatttcactttttggaattaaccaagtatcttgatcatcttcaacagttgtattatcaagcaatgcccatatatctgttggacgatctcctttttttgccttatcaccaactaaaatgtatacatactttttatagccaccatcttcaaaaaaatctttataagttaaattttctctagtactatctgatatatacatacatggtgtaatatatttatacttttccttatcaaaatctttgttataagttccaataacctctaataatgaatctagttctatatcagagtatatacttgcatataatttaggtaaatttgtaataaaatctgatttgttttcacctgttttttgcatcatccactcttttgtatattctttagtctttccttcaaataatttatcatccgacgtgactccttgctcttttaaataattcgaaaattcttgcatcattttgcaataatttttataaatatttcttccttttacagtttcactaatttggatagatggaataaaatttgaaagattaacatctttatatgttttacttgtcgcctttttataagtaccattgacgataattggattaccactctcattaacagtaatagaataattagctaaagtatcatccacatcaatatctgtatctttattttcttcatcaactagagctttttgttgcttattcgttacatctttataatgattagaatctgtaaaaagattaagtgcagtaacaaaaccaaccacaataattaaagatgctgtactaataattaatagagagatgattacttcaataagtgtcataccttttgtatttttcatattcatccctcctactcaatttttaaccattgatctgtattgcttacagcattttttatactgtctacatttaaaaaatcactttctctaaatgatttatttttagtaacataccaagattgatcataataaataagataaactcctccattacttgcaccacttgaaggagatgcatagataaaatactttccattactatttggaaatacatgaaaattaacatataaatctggataccatgtattattgttaaaaacaatattttgatctttaacttttcgataaatatcatcttctaatttatcgaactgattattttgtgtcatacatgttaaatacgcttgtttaatatgataatcagagcccccactattattaaaccaccaatcgcaattataattagcatccgtagttttattcatatacttacattgatctttataccaatcaataaatgtataaatatttttaaaatctccatagtattgattcaacataaccgtaagtcttttatcaagtgtatctgctatattacttccttctggcaaaccaatattattgtcattatcattatctgtactaccattatttcctgaatcatttccacttgaactactatcagtaaaaatatctcgatttccatttgtatcatattgaacacatttccattgattgttagactgcgttaaataagcataaattgtataatcttcatcatggtaattagcttttagtgatgcaataattaaattttctttttttcgattaattttaatatttgaaattgttccataaggaacagaacattccatctttgatacattaatttgtttacctttatctggaattagctgcgaactattttcatcattttcaatagcaccagctagagatttaattgccgaattagcaatcaattcaacttgtgtcttatttctatttttaatagattgattataagacatatatgcaaaagacaaagaggcacctacaatgactacaagaaccataatcaatgtaattgcccatacaattgttgatccctttttatttttcattgtttgcacctcttttactatttttctaccatataaactgtatatgtaattgttaaatccaagttacctgttgaattttcataagcaacagaattaatatgtaaaccactcatatttttaacatcttcaattaaattgagtaaattagcttttgttcctttacatgtttgtgtaacaacacatgaataaactaaagcattggatgatttagattcatctgtattatcatttgcgttatcagatgaattatcatcactctttttacttgataaatctgtttgtgttatttcagacattgttaaattagtaggactgattttatgttctattgttagatttgtaatcaattgatcaatatcttcttttgacataagattgtaaaattgatcatttaaagctttaatttcttgattaatattcataatttgtgttttgatatcttctgttgaagaagatgaacttgttacttttaattcagtaagttgtaattctaaactatcttttgaagactttaatgatgtatgtgatgttaattgtggttgtaataaaatcaaccatccaaaacaaacaatcaataaaatcactaatatataaatcaatgtcttttctctagaagaaagttttttaaatgaatctttaatcttgtccacttgtcgtacctccttctaatgtacatgtaatcgatgatttataagtaattggtgtcgtattcgttactgtttgtgttgttgtcgcacctgttgtaggatctgttacggtttccgttgtttcactaacaccaccatcttgagtatacccattgtaatcaactgttttaaaagtacctgattctctaagtgttcttactgtttcttcacaaccattaactttagaagctgttacagtaagtgatatagctcctgtttcttgattaaatgatattgaatcaattgttaagttcttacatgatttatcaattgtttctaaaatacctttatcaatttgagggtattttgataatgtttgtgtaattgtttgtaagtttgtaagttgttcattgagcttacttaattctttttgttgatcagaatttgtattagatgctgttgcagcaagagcctcttctatttgtgtttgcaatgtatcaacatccttttgcaagtttctattagtgattgttaaataaagtgtacttgtcgcaaaaataagaatgagtaaaacaggtaatgctataagcaagagtgttttagaatttatatttatttttttctttgttttatagacagataaaaaatcaatatctttgttactgtttcttgccatcttatctcctccataaacttcctacaaataaatatttatgaataggaaaattattatctttactacaagtatggtttgttggtttaaaacgagatgtctcaatactcaaattagaagaaatagttgacatcaacatatcttcttcataagtttctagccccgcaaaatagattttttctaattgggcatctttataagtacctttagtaaactgcattaatttagtaagtgaattggacaattcagtaataaaagcaactgttccacgatcagagaaaatacgtattctattagctatttcatattgtccattaataaataaataatgaataacatcttgtccattgattactgttaaaacataagataggtttgttaatttaggaatagattctgttaatttaataattgaatttgtcataatatcaattgattctaatgaaattcccatttcatcaaacaaatcaatatacggctttaaaaactctctttccattgccgcacataaaacgagttgaccttctttaccttcaactttatattttatgattgcataatcatataataaatccgtatattgactttcaacgtcaataaattcatcctttacaaattgaagaatttgtttatgagaaacttttggtaaaacagcacacttcactaaaatttgcccactatcgacaacaagtctcacactatcaacattttctttttttaaatcaagtaaaacatctctaacaggttgatcatcaagaatatttccatcaagcattgttccttcaacaaattcaaattctttgcaagaagaaatatgaatattattttttgaaacatttccttgaaccatttgtaatccttttgttgataaaaatacaatataactcataattcctcctacatatttcctacattgttatacaatgtataaattggtaataatacagatataataattaaacaaatcacaaccgctaaaaagataatcattaatggttgaataagggtaatcattctctctgatgcttgttctgcttcaaaatcaaaatcatctgcaagagttgtaagcgttgattccaaacgtccactttcttctcccacaaaaatactacttgttaatttaatatcaaaaccatcaatgtccttgattgcttgagataaactttccctgtttcttaatttcttaatagctccgtcaaactgtgattcaatataaacattaccaatcgttgttttagcaatatttaaagcattaacaatagacatcccacttgtatataaagaacataaagttcttgcaaatctgctcgtataaattgtcatcaacaatttaccaaacttaggaatttttatttttaatttatctacttgaaaacgtaccttttctactctaagtaaagcaataaaagtgacaaccaaacctgcagcaatcaataagacaaaataccaataatcttgtaaaaacttagaaatactaatattgattttagtaatcaatggtaactcaacattttgaaaaatatcaaagaaagaaggtaacaccgctaaataaacaatcaacaaaacagcaattgtaactataattaaaataataggatacatcattgctgatttagttttacctttaatacgatgatccttagaatactgatcagacatcgttaaagccgttttatccatatccccacttgcttcacctgaacgatacatttgaatcattaaattaggaaaagcaacaccttgagcttccatagcagcggataaagtatatccttgttgtaactttacataaatattttcataaattttttttatttttttattatcttctcttcgaaccataatagaaaaaatacgaatcaaagataaaccagaagcaagcattgttcctacttctctagaataagctgataattcatttaatttcattttatactgattaacagtctttttagtgacatcttggcagcttactaaaaacaaattttgttctttaagctttctcactaaatcatttcgatcatcagcttctaatgttcctcttattgttttagctgacatatctttcgaaatatatttaaatgtagccattctatcacctctttacatcattaaatttaaataccaacttataatttcactaccataagataaagcaataaaaataccaattgataaataaggaccaaaagcaatatgtccttttttattaatctttttacttaccaataaataaatactataacttcctgcaagtaaaataccaataaaagcagcaagtaaactatacttccatcctaaagctattcctgagacaaacattaatttaatatctccaccaccaaaagactcagcaattaaaacatttaataaaatcattggtacagaaatacaaaacatacccataatactttctaacaaagacatatgtcttacatacattaaaataatagatacaagaagcatggctatatttaaaccatcaggaataatcattgtatcaaaatcaatcattgtaatcgcaagtaaaatcatcgcaatcacaaacattaaaatcgtttcaatactaaaaccaaaacgataaaaacaaaacataccaatcaatccaccaaaaatttcaatcaaaaaacctctaataggaatcgaagtatgacaataacgacacttaccccttaaaaaaatataacttacaataggaatcaaatcataccattttaaagtcttaccacaatgatcacaatgactccttccctttacaaaactctcatttctaggaacacgatcaatcacaacattcataaaacttgctacacacattcctattaaaaacatatatacataaattaaaataataattgaatccataaaaacctcatctaatcaaaattatgattactatcagtacttacaatctttacatccttattctttgtgagtgtagcttcaatacgatgatcatcatcactgatccaatacattttataagtattgccatttctttctacatcaacatcatctaactctgtcttttttgcaataatgcctttcaattgattattatctgcagtagcaattgtattaccactcaatatatctttaatataattatctatatcaacttcactaggatcatctgttgccttatacttagccacttctgtttcaacaaccgtataaatagaatgcgcttcttgaatatagcgagactctttagcttcatttacataaccaattacagaaggtacagcaatcgcagctaaaatagctaagattactaatacaacaataatctctaccaacgtaaaacctttcttatttttcatcttcctcaccctaattaacacttactgttatatctttatttcttttaattacagaataaacattctttccatcatcacttgtaaaattaacatagtactctgcattatcttttccaatatgactacaagtaccaaacgtcactttttgaatagcagtttttttgttattgtttctgttaattcttttttatactcagtatttttataagtatcatcatttaattcattgcctaaagctttataccttgcttcctctgtttgaataactgtataaatagaatgagcttcttcaatatagcgtgtctttttagattcatctacatatccaagaacagcaggtacagcaatagcggctaaaatagctaaaatcactaacacaacaataatttctaccaacgtaaaacccttgttattcttcaatctttccttcatatgcccattccccttttttggttatattataacacatatatataaaatttctaataatccaacaattttctctcaattattacataaaaaaaccattcttataaggaatggtcataaacttcttagaataaaattataataatttaaattattcaattgatgtaatcttaacttgtttattcttataaagttctgcttgtatttttttaccatcatcacttgtccaatgtaaaagataaacataatcttttccagaatcatcagaatcaccagaataaataaaatccatactctttattccagttttcttagcaattatattttcaccatctggattatcagctgttttattacgaagttttgtatacatatcttccatattatggtatgaatcacctttatctgtgtaatctatttcattttctaatctagcttcttctacctgaataacagtgtaaatagctttagcttcttcgacatatcataaaacagaaggaacagcaattgcagctagaatagccaatattactaaaacaacaataatctctactaatgtaaaaccttttctattattaatcttcttcataatatcacattctttctaatagatttagtatatattatttataagcaaaggaagtcactgaatattcagtgactttaattaaatgattaatctaaatcagttagagctgatccttttttatcaattttgatatctttatttttcttaatagttgctttaacaaattttttatcatctgatttccattttacaacccattgagtagttgtttcttttccagcattatttgtttcaactgtagcttcagcagatgatacttctaaagttgtagtttctttaatttgttttttaagtgtttctaacgcttcagctttcccaccagtaatagcaccataaacaggatcagtaacatctgtagcagtacaatatttaccattatttaatgcagcagctttagcttcttctgtttggaatactacatagattgatctagcttcttgaatgtatctagattctttagcttcatctacataaccgattactgatggtacagcaattgcagctaagatagctaagattactaatacaacaatgatttcaactaatgtgaaaccttttttattagattttttttgtaatttctttaataattctttcatcatttctttttttctccctctttgatatgatattttaaagaaatcctatgacagttaaaaaccacctattattttggtggttgctataactcatagacatacgaaaatatatcttgataggttagggtaaccggcaatcatagcacttacgtactttagaccctagggctttgcgtcactgtttttcaacagctttgcctttttcttttctttacaaatatataataatatttttaaagggaatttgcaacaaattcccctctaattcgaccttttttcacatatttttataattgaacaatcaattctattattttttgatagttatctttaactatttgtagaagtttacctgcttcttcaagttcttcatcatttaaattttctttttctcttaaacattctgttaaattacaacttgcttgatataaatcatcaaatcccaaattaacacttattcctttcaaggtatgaataaaacggaaggcttctttataatcaactttattaaaagcatcaataagattatcaaatgtttcatcatctttaaatttcaatacaaattttctaataaattcttcattaaataatcttcttttaacatcttcaaagttcccaccaacttgtttgtaaaattcttctaactccataaacaactctcctataatatttctatgtctcctaatatccctaaagcttcttcaccatcataaataacttgtacagttattttaacatctttaattgtattattgattttaagttttgtattcatcgaaaacttatctttttctttttctaaatcaatagcttgttgtatgaatacattaaaatcattattaataaatagttttgtaactttttcattacttaatggatctataattttaggttctatatttaataataatgcatcttttttagataatgtaagtaatggtggtacaactgaatattcaaattgaatattattagataattcactgtaaaatttatattttgatttttcaaaatataaatcttgataaagtaaattagataaattaagaccttcatcttttaaatgttcttgtgtacgttcttcaaaatattcattatcttcataaaattcattaatttttaaatcattttgaatgtatgattcaatatccattaaacattctataagtaaaggattaaaaacaccacatttgcctttttgaatcatttttaaagcttcttcatgactataagcctctttataaacacgtttacttgttaaagcatcatatgcatcaacaattgaaacaacttgtgccgcaataggaatttcttctccttttaaaccatctggataaccatttccatcatatctttcatgatgccatcgacatatttgataaccatattttacaattggttcatcattataaaatggtaaactatttaacatctttgcaccgatgataacatgtgatttcatgacttccatctcttctttagtaagggatgatggtttatttaagatttcttctggaatagcaatctttcctatatcatgtaaagaagaagccacttcaattgaaatcatatcatctaaagttaaggaatattgatttgttttcttaactaaaatatttaataacaattttgtaagttttttaatgtgtaatacatgtaaaccactttcaccattacgagattcaacgatatgacttaagatcataatcatcatatcgttatttttatatttttcatagatttgtttattaatgatggttgtaagttttttttgtcttttataatgtgaaataatattatttatttttttaagacaacagcagatgaaaacggtcttgtaatataacctgatacacctaattcataggctttttcaatacttttatcatctttatcgatagaaataatcatcactggtacttcttctatcaaatgattttggttcatatactttaaaacttcaaagccatccatttcaggcatgacaagatctaataaaacaagtgcaacacttttgctatcagattttaaatattctaaagcttcatagccatcttttgcttctataactgtatattgatttaatatttcagagagtatctctcgattagactttgcatcatcaacaatcagtattttcccatttttatccatcctaatcaccctcattacgccttattaatttaaaataaatatcttttccagataaaatagtatatcttcttttaagcttattataccattttaatcccttttgattttgatacaataaaacaataaaatgaataatgatatttagttcaaattcttctaactctatttcaccataaaaactcttttcaaacaacctacaaactcttaaaaaatcaccttgatgaatcaaatccatcttttctaaagtctcatccacttctatagaatctaaccccaattgataatctataccataagatttcaaatacatttccattaaactatataaatattttgttttatttttagaagaagcatgatgataaatatatttaacacctatatttaaaatcaatcttaataattctaataaaatccatataataaagataactacacaaacaattgttaatacccctaaagacatcatacctaaatttccaacatgatcaattaaatcattaatcatgccaccattttgaccatcatcaacagattgagaatcttgatatcctttttcaatatttgtatcactttgttctccttgaggagttgcgatcatattcattaaagtatacacatcataataataaccaggtgtaacatcaattggtaaccatcccataccatcaaaatatacttctacccaagcatgtccatcttttgaggttaaagttgcatttccctcatcatcaattgcatcactttttaaataataaccttctacatatctagctggtatatcgtaatatctaaaagcttcaactgctactgtcgaaaataatacatcattacctgctgttttttgatttaagaaatcctctaaactatctttatcacttatttgatcatcatattttaaataacttgtcattgtatctctaacatgttgacaaacagaataaatacctgtgttttcaaaatcatcttgatcaaataatcgagaaattgttttttctaatcctttatctaccgtttgataattttcataaacaaatgatctatagatagattcagtatctaaatattctttttgtgaagcatttggattatttaaccaatcacttccaaccattaattcacttggtgaagtagaggaagtttcttgatagctatagcttttacttccaaataaggctattgattgtaaatttaaatctttttgaatatttgatgatgtaacatcactttgattaattgaataaggtgtatataagtattttttatttgctgctacgttattaatggttacattttgtttttgatcatcattctttgatagtttttgataaaggttatattgatatgttgaagaaaatttcttctttttcaaccatttcaacataccttcatgttcaccattataacttgcttttgtcaaatcttgccattgattattttctaatgtacttcctacaaatccttttaaatataaattctttctttgtgaaactgttatttctaatctctcttgattatttttatgaatactagaagccttatttaaattaccttgaggtaaattatctttaccataacgaagatcatctacttgttgtaaaacatcttctttaatttgttcaattgttaaattatcttggtaacttggtatcgtaagagaaacaaagataatacaaagaataataaaccattgaattgtttttgtattaattactttattttgatgatacatccataccattaaagcattaatactaaataaagagcctcctacaaaagaaaaacaatctaaccataatgtaaaagaaaataaaacaaagaaaagaatagataacacagtatacttttctttctttatagaatgataaatataataagtcatccaaataacaattactaaactcattgcttgtatatgtgatgatgtaatagaagcagccatcatcatatttctagcatcttcaaattttgtattataacattcaataatataattcattattccaaagaatccataataaaaactttgaaatgaataaataattccaatcattattgtcatcatgattggtaaaataattgtttttatttttttatacgataacaaagataaagctagtaataaaacaatactcacaattatttctaataaccaagaacttattactacattatgataaaaacatagaaaactgataccactcattaaagaataaaagaaggtcacaatgaaagaaataattctattttttttatttttttccatatttgacctccttatatttcaaaatgatacatattttgatcaattgaatctaatggtaattcatataactgattttgaaaatgtttgattgtttgtgcattttgaatatcatttttaatcgtaattgcactaatactcaaaaaatcatttaatctagataactcttcattaaaatctccagcagttacataaatcatctttgtaaaatataaatctaaatgctcactcgcaaacaaatgaagtgcatctccaccttgacttgtaatacctttagaaatccaattttccatgttttgataataatcttgaagactattcatttctaaccaataaaaacttccttgatcatataaagcaacataatgccctatatttttcaataataacttttcagacatactcattgcaaaagctaacgatttagataaaacatgtttatcaatttcactcgtttgatcttttaaaccaatatctacaagtaaaacagtttcaaaactactattatgagaaccttcctttaataaaacttctcctgttttagcagaaagtttccaatgaacatgacgaatatcatctccaggataatatgtctttaaatcataaatttcagacatatctgttcctttcttatattggtactgtaaaacaccattttcataaggtttagaaagttcattatataataattctatatttactttccctggataaaccacaagatgatgtttttgagtttgtgaaataggaactctacaaaacccaaaaacatcatataaataaactttttcatatgaaatcatgacattcccacaataagtcgcagtatattcttgattctttcgggctgtttttattcctaatggaataaaaatatttcttttgagttcattttttaaagtcatgtttttataaacaaaaacataatctattcttccagaaacaagtagtctataacgactctttacttctgttgtaaatgatagagactgacctacttttccttgctttggaccttggatatccatttgaatatatcttaattccagtttcaataaagtaattaaaataaatggaaaaacaataccaatgatccaaataattaagaagtagaaatatgtagaataaatataggcaataagtaccaagaaattaattattccatacaacaaatatttattcttcatcttaatcagccaaaggaggtttaatttcttttaaaatttcatttaaaatatctctagcatctaaaccttctatccttgcttgtggacgtaatatcatacgatgtgcacatacatctaaaaagacatattgaacatcttctggaataacataaatacgatcttctaaaacagcatgtgctttagccatttgtacaagtgctaatactccacgaggagaaacacctaactctactaaaggtatttctcttgttttttcacataataagacaatatattttaaaacatcatcactgatacgtacagaagataaatagttttgtacttcaatcacattttcttttgaagcaacttcttcaattctttcaattggattatcgtagcgacgtgatttaataatttctatttgtttttctaaattaggataaccaatagataaacaaatcataaatcggtccaattgcgattctggtaaaggttgagtaccagcagaacccattgggttttgtgttgctatcgtaataaaaggatgtggtaaatcataagtaacaccatcaactgttacattatgttcttccattgcttctagtaaagcagcttgtgttttaggcgatgtacggttaatttcatcagctaaaagtaagttactaaatacagcccctgatctaaattcaaatttttgtgtttcgttatttaacattgtaaaaccaacaatatctgatggtaatgtatctgttgtaaactgaattcttttataatctaaacctaaagctttagaaaaagctaacgctaatgttgttttacctgttccaggcgcatcgtttaacaaaatatgtcctcctgcataaattgtcattaaaacctttttaattatttcatctttaccaataaagacttttgagacttcatcaataatatgttgtgattgttcaattatcattttcatctacctcattttctaaagcttcttgtttattttcatcttgttgatcattttgattttcatcattgacttcttgttggttatcttctggtgctttttcaacatcaggaacaacttcctgattgtcaccaggttgagtacctgtttctggtaaagtatatcctaataaaccagcaattttctttactgattgattaagcttttcttcgttaacacttggatcattatcttcacaagctatgaaacggtacttccaagcatctatgtatttttgttctaaacctttagctgcaccacttaaagtaatatggaaatcttcactagccatgtcaccaaaagtatattcagtaaatttattatagaataattcaattggtgttgcattttggaaaacaatttcacttaaactttcatccccaccaaaagtatttgtccataaacatgcaggataatctgtatcatttccataagtttttggaaaaataacttttgaaatatttgatccataaaatgcaacttgcccaattggtcctaaaccatcaggtaaaacaagttcacccgttaaattcgttccatagaaggcataatcatcaatccaatacatatcatctgtcatattaaattgaatggaagtaattggcacatcttcaaaagcacttgtacaaatttcaaatgtaccttctttagtagccacatccccttgaacatctgttgtggcattgattaaataaaattcatcttctactgtaacagtgtttccattttgatctgttcctcgagcatatccataaagaatttctccaccataagattcatctataaaataagcaccactatatgtattaccaccattataaccttctccatcaaacgggatatacatttgtcttgttactgaaggcaaataatcattttcaaaaatagcttttttagcattaaatgccatataacgtaaatcaaataaccaactatctgtaatttctaaagcattttcttgaatagtgatgctatctgtattttcagagaaaatactttctaacgcctcacagccataaaaagcatagctatcaatttgattaatatgtttagataacttgacatgttttaaatttttacattcagaaaaagcatgttgtcctatttctgtaattgtaacccctggaatactattttcgtcaaattgtattaaattagtaggtgcatttaataaaatcgtcgcatgtgatctatcacgataatacatttctagatattcaaaaccattctttgtttgaaaacttgaatctgtttcactaagtagtgcaaatgaagcttgatctatttcattcttccatttatcatcatataattcataataatttattgacacattaattgcttttaatgaatccgcttggctaaatgtatcactatttgtacctggaatatctttcgttaaaaaattaacttcttcaacatggctatctttaaaaatttgatgtcctaattcaacatcaccatgagtaaagataatacatataattttatcattaccactaaaagcataatcatctattttttctactgtttcaggaataacaattgttcctgcggcactatccattgtactcactaattctctttcatcatttaagaaaaccaaattattattcaccgtataatcatacgattctccattttcattaattaaatttgttacaaatcttctataacttttcttaaaataatccaaataatattcatcagggacatgaataattgtatctgtttgaatattcttaaatgaactttgatcaaccatacatggatcatcaaaataaacatctgatacaaaccaggaaacaatacctttaattgctgtaactcctttaggaatataaattgcatccgctatcggtgtttgataaacaattgtttgatctttattcattaacaagccatcttcattagaactatattttgtattattttcatcaacaatatacttaccataaagttgtaaaccactccatccaaaatgggcactttcaatagaagcaggtatataaaaatcgccatagaaattttgccaacctgcataattcatttctatactgtttacttcttcaggtacatgaatatccgcaaattcatcaccactataacctgtaaatgcataattataaattgtatataaatcttccgcaaatacatattcactttgtaattgaacttcatacccttcaggtaaatctttcatttctaacggaataagtgaaattcttccttttttatgagctatatatgctgtttgtgaatcaatatcgctaccatcttcatttttccaacccataaatatttgtgtttgtgtttgataagttggtacgatcaaattatagtattttcgtaaatcttctgtttcctctttttttaagtagaaataacctgtttcttgttgattgtaatcttgtaatgaaatacgtgtttgatattcgaccttaaatgtcacttcatattcttgccaaggacttgaagcattcattctaaaataaaactttactgtaaaatcttccgttgcatattgaggataagatcctattttaaaattatcattgtaatcttctattcgataaagtttaggcaacttaccttcttcattttcagcaattattactaccatattacataataatttccaaggagtaatgacacaaccttcatataattgatcaacactttctttagataaaaattctgtacttaaaaattgaattgtataactagcaccttctttttgaagaataccatcatttgtaaatgttgatgcatctccataaattaaatcattagacatatctggtaatctagctatcggatcaggatcaactattggtgttttattatcatgattggtatttttatctactacttcatttgaaatacctgttcctgtattatttattggtatctcttgtccaggaataacaactgtaacattaccgtcacctgttccatttggattaacacctatagtattatttccattaacacctaatcctatttgtccatatatctttgttggatctactcttccttgatttttaaagagatagggtgaattgtttaaatttgtttgtgatattttatctaatgattgttgattttcttttaaatactgactttcatctggttcttgatgagtatgagtttgttggtcttgatttgaaaaaatgacttgattatttttgagttctaatgcttttgatcgcggtgaaaagatagaactgttttgagaaagttgataagcagaaatcgcacatgaaaatgatactactgtgactactgctacttttcctaaataaggaattgataatttatatgtttttttcatctatgtctctccttgaaaagaattgacccaattctttttccatttcatcaaaatcaatcggtttagaaaaatgtccattcattcccgttttctttgaatatcttttattttcaacataagcatccgctgacaaagcaaagataggaattgattgactatcttctctatttaaacttctaattgcttgtgttgcttcataaccattcatttcaggcatttgaatatccattaaaatcaaatcataataatgttcagcatgctttttaaaagtctctactgcaacttgtccattttctacacgttcaacaaaagcccctttagcatttaaaacacttaaacaaatttcagcattaatatcattatcttccgcaagtaaaatacgtttttgatcaaaactaaattcttctacaacaacttcttttttatcttcatattgttgattagtagaaattggtaaatttaaaaagacagtaaaatcactcccctttccttctaaactatcaacaacaatttcaccacccatcaacttaacaagttgatctgtaatagccatgcctaatccactaccaccatattttttagaaatctctacaccttcttgttcaaaaggtctaaaaatatgacttaagaattctctagacattcctttaccagtatcatgtacacgcatcataatattagccacttgatcttctttatacatttgtctaaatgtcactttaatttcacctttttcagtaaacttactagcattagacaataaattaacaagaatttgcataatacgtaattcatcaccaacaaaatatttaacatcaaaatcaaaatattctattttaaacattacatcttttttctcaattgtttctttgaaaatattatttaattgaggttctaaatgataaatattaaatggtttattttctaattctaattttccagcttccattctagacatatctaatacttcattaattaaggaaagaaggtattgagaaatatcttgagcttgttgtaaataataatcttcttgtttagtatcttgtgtatttctagctaatgtcaacattccaataataccattcattggtgttcttatctcatgagacattcttgataaaaaagatgctttatattcactttcattttttgtagtttctatttgttttaaataatctttttcttttaaaacatcttcactatgatcaaaatggaaataaatgatatttaccattttctatcgcacttactgtaagtacaaaccattgatctacatctttcattttaaaagagtatttaaaagaattttcttgattccatgattgatattgtttcataaaatcacgataaactctttcctccaccatttcttttaaaaccataaaatctacaactatacgttctttagctatatgaaatacttcttgaaaacgtgaagaaataaataaaactttaaaatctttagttctaactaaaacataaagttgactttgatcttcatcaaatatttgattagttaaatcatttttattaaaatgagagtttttatattttttataaaagaatgaaatcatatttaatacaataatgatacaaataatcactaaaatacctaataaaattgtttgactattctctcctgcagccataataatctttttcatacaaaaccctcccatttgtctaattacccattttttattatagaaccaaactaacatttatgcaaattttcattttctgttcataaattatagttataataaataagaggtgattttatgaatgtaaatcaaaaagagattaaaaaatatatgtatttaataagttttgctggtgttgtactagcaattattttaaatttatcacaagtatttcattttattcaaactatatggaaacttattgttcctttttttgtaggattttgtattgcttttgtattaaatattattactaaacaattagaaaatacacttttaaagaatagtaagaataaaagaatgttttcttttattattacattaatactattatttgcttttattattcttatttgttttattgttggtcctgaacttgttcattctattaaagaaattattagattagcacctaatgcttatgatcaatttatccaaacattaaaagataatagaaatataatgaatggtagttttaaaaatatgattgattctattatttctttagatatagatttatcttctttatataaaactattgtaaataattggcaaacactttttcattcaggattttctattttatctaatacattaagtagtttatataccttttttattggtcttgttttttcaatctaccttcttttttcaaaagaaacattatctaaacaaataaaaacaacatcccaagtattaattggtcaagaaaaaacacaaaaaatatgtaatatcatacaattatctagtcatactttttctaattttattacttgtcaatgtttagaagcttgtatacttggtagtatgtttgttatttcaatgtcaattttacaaatgccttatgccttgttaatgggagttgtcattgctgttactgcattaattcctgtttttggtgcttttattggttgttttgtaggaattattatgattggtatagttaatcctcttcaagctttagaatttattgttttatttcttgttttacaacaaatagaaggaaatttaatttatcctcatgtagttggtaattcagttggtcttccttctatatgggtatttgtcgctgttattattggtggtaatcttatgggtatattaggaatgttcttatttattccacttacatctattctttatactttatttaaagaatatattaaagcaaaaggagataatcgttcttgattatctccttattttatatcttctacaattttattaacaatatcatctaatgtcccatcgttatcaacatgataatgacaactatctaaataaagatcatgtctttcatcatagagttgataaagtttttgagggccatcttttaataaaggtcgatgtgctgtttctacatcactcacaatattatctaaaggtcgatcaatatagaaaacagtccccgcttgttttaaaatatctcgattttcttttcttttaataactcccccaccagtagagataatatagccatcaagctttgccatatctaaacatgcttcactttctctgtccctaaaatattcctcagagatagcaaacatatcaggtattgtacattgatatttcttttcaatatattcatccatatcaataactggcatctttaatttttctgataataatttggagatggttgttttaccacaccccatgattcccactaatataatatttttcattcttacgcccttttataatttcccaatacttttaacgttgtactatttgctttcattttattaatagcacgttgaattctttcttcatgcatatttccttcaaaatcaatatagaaataatattgccaatattgtgtttcaattggtcttgattcaatacgatccatattaatttgactttgtttaattgtttgtaacatgttatctaaagctccaacttgatgtggtaatgtaaagataacagaaactttatcactttcttttggacaaataagttcttttgaaatcaccataaaacgtgttctattgtttttcttattttgtacattttcttttaacatttctaaaccataaagtttacatgcaagtggtgatgcaatggctgctttagttggatcttttgaatctattacatatttagcagccatggctgtatcttgaaatggtctttgttcaatataacgatgttgatataagaactcactagattgtgctaatccttgaggatgtgagtaaacttgtcttatatcttcaatctttgttcctggaagtgccattaaacattgactaacatttacagcagtttctcctacaatataaaaaccatattttctaattaaatcatagttatcattaatagatcctgttaagctattttcaataggtaaaaccccataatcaatttcaccattttctaatgctacataaacatcttcaaagtctttataaccaatatttcttgtcccttcaccaaagaagttttctacagcactttgagaaaatgctccagcaattccttgatatccaacaaggggatcttttttgaattcagttttaatatttttatctaattcaagtggtaataaatctgattgataagatttagaaactgtcatcatttcttgaataaaacatcttgcatattcttttaattgatcattatttaaacgattaagattcttttcaataacttctctttctctttcaggttggaaaatttctaaatgattttcaattttatattcaacgacacttttagaaagagccatacgtttttcaaaaagttccattaattgttgatcaattgcatctatttcaattcgacattgttttaaatctttcatacttattcccccatcatatcaagtattcctaaagccatcattgcttctacaacaacaactgctctttgtacaatacaaggatcatgtcttccttttatttttaattctacattttcttttgttgcaatattaatcgtcttttgttttttagcaatcgaaggtgtaggtttaaaagtaaccgtacaacttacaggcataccatttgtaataccaccagtaatgccaccattatgatttgtagaagttcttacatttccttcttcatcataataataacagtcattggcttcactcccaaacatttcatcaatactttctccatcgccaaaagaaacacttttaacggctggaattgaaaacatcaatgaagataaatgactttctaaagaatcaaagaaaggttcacctactccagcaggaacatgtaaagcaacacattcaattttaccaccaacactatctaaattttctttagcttttaaaatcgtttcttccattttttcaaaaacaccctctttaattgttggatattgtttttcacttaattttaaaagcatttcatcatctacatttacagggaacttttcatctttgatttttccaattgataaaatatgtgctcctacaataattcctttttgttttaaaatctgtttagcaatatttcccgcaaaaacgattggggctgtaattcttccggaaaaatgcccacccccacggacatcattaaatcctttatatttaatataagctggataatcactatgtcctggtcgcatatttgttttaagtaaagagtaatctttagaatgttgatcactattatagatgactcctgtaagaggtgctcctgtggtaataccatcttgtaaccctgataaaatttctacttgatctgcttcttttctagctgtcgacattttattttgtcctggtgctcttcttttcatatcacgcgaaacttcatctaaatcaatttgaataccgctaggaaggtttccaatggtaataccaatagcttttccatgggattcaccaaaaattgtcagttctatattatttttataagttgcccccatcgatttttcctcctaacatctcgaaatcttcccaaaaacttggataagattttttaacacattctttattatcaataatgactggttccttacacactgttgaagcaatcgctagcatcatcgccatacgatgatcatcatgacttgatacatttccaccagttaaagtttctacgccatctaattccatagaagattcatgttcaactgcatgtgcttttagtttattcaattcttcaactgttgcttgaagacgatcacattctttaatacgtaaacgtccggcattgatgacttcactatgtccacttgccactgctaaggcaagagagacaactggaataacatcagggcattgactcgcatccacaattgttgcttttaaaccatgactcaccactttaattccttcatcattttccacgatttcacaattcatttgttttaaaaaatcaattgttgctttatcaccttgtaaagaatctaagtttaaatctaataatgtaacatcatttcctaaagcacccgctactaaatagaaagcagcttgagaaaaatcagattccacacgataatctcttgccttatattcttgtctacctcttacaataaattgtttatattcatgattcacaatttcaataccataaagttttaatacttgtaatgttaaatcaatatatcctttactttcaagtggtgtcgtaatttcaatgattgaatcaaatgataataaaggtaaagcaaataataaaccggtaataaattgtgatgaaatattacctggaatacgataaagatccggttttaattctccaacaacatttaaatctaaaacattttcacgatataaataaccaatattttgtctttcaaagatttcataataggtatctaatggtcttttccctaattgtcctcttcctataaaacgtactttattttctttagcaagagaaataggaaccatgaagcgaagcgttgatcctgattcttcacaatcaatttggactcctggcatcgtattatttttagtaaatgtgtaattaccattaataataagataatcttcatgttgttcaataattgttccaagtgcttccatcgcaccaattgttgctttaatatcttgagaatattctatatgatcaattcttgaaatacctttagcaagactagctgcaataatcgcacgatgtgctaatgattttgaaggtggaacagatacttttccttttagttttgtaggaattaacttaatttgactcattttataccctttctttttttaataaaaattcttgatttgtttgataaacataactatctcctatttcttttaataaaacaacagataacgaattattaatattctttttatctaaagaaatagcttgaataagattttttgtttcaacttgacattcatatggtagattgtatttttgtaagatttctttaatttgcatggaagattctgtttttgtcaaatctaaactttcagcaagttttgtaatttgatacattccaatacctacggcttccccatgtgaatatttttcatagtgataatattgttcaatggcatgcgcataggtatgaccaaagttaagtaataaacgatcaccaaaatcaaattgatctttttcaacaacttctcttttgatgttgacacaattatatatgatttcatcaataaattcatagagttcttcaaaattttgataagaatttaattgatcaaataattttttatctttaatacatccatatttaatgacttctcccatgccatcactgataaaatgtggatctaatgtctttaatgtacatggatcaatcaaaaccatggatggatgatagaaagctcctaccaggtttttcccttcaggtaaatcaaccgctacctttccaccaacagaactatccacttgtgcaagtaaagaagtaggaatttggacaagttttacccctcttaaataactacttgcgacaaatcctgccatatcaccaatcacaccaccacctaaagcaatgattaaatccgttcttgtaagtttaaaatctaaacatgctttataaagtgctggtaacatatcaaaacgttttgatgtttctccatgttctacaacaacatgacttacttcataatctttttcaagatttcttgttaatgcatctccatataaaggataaacttgatcatcggaaatgatcattattttctttcctttaaagatttcttttattttatcatttgctttatctaaaatatgtttttctatataaataggataactatgttcctttaaattaacgatcatttccattatcatcaccttataattctttccctactgcatcagcaattggttttaattctttcattaattgttcaaatttggctggttttaatgattgtggtccatcacataatgctttttcagaagatatatatttgtcatgcatttgtatcgcttcctttattctataatctatttcaattttatcatatggtttttcgtttttaaagagatacatcaactgattaaaactcgtcatttcattaattacttgattgatatattcgagttgaataattgttatttccatacgattaaatggatagacaatatgatgttcatcatcaaccattctaaagtgacatttataaagaggtgcgttatctaaaatatgcccataactgataattaatgatcttactacatgagcactagtataatcttctccctgttttacctgttgtcttaaaagttcagcattataaagttcaaaacgaacaagtatctcttcatttaaaccataagtttgtaattcgatattgtagagatcacctacatcatcaatagctaaaatatctaaaataagtttcttttcatagaaatttttaccatattgttgtgcgttttttaatttagtagaaacaatctctctgtctaaaataagctcttgacaaataagggttctaattctttcattttcaacaagcaaatgatgaaaatataaatcatttgaatattttttaaaattctctctatttttgttcataaaaagtcctccattatttatattgacttttcatgagtgtttttctttttttttatcaaaaaattaaaatttttaagttttgaagatgtttttttaattcttcaaattctttaaaatcatataaatgatctaaaagatcaaaaatttgatatttagaaagagtatttatagaactgcttatatcttcatgaaattttagttgagagtatttgataatgctttcttttgtttcattgattagattttcatattttttatttgcttcttcaagctttctatcacgagaacgtaaaagtatttgattatctaacaagtcaaagtattctagatattctttatataaattatacatatttaccacttcctactatctataatagcatattttaaataaataaagaatatgtaaaataaatttttaaagtggaaataaatggatttaaaagagattattatattaatttgttgatagatacatgatacaatagggataggtgattttatgaaattagaacttttaacatatgaaaaagagaatcttccacgtggttggaaaccttattatatatatttaatcatggtcgatcatatagaagtaggaagaattgtcttaagagaaggtagtaatgaagaaagatattatgatggacatattggttatacgatagaaaaggaataccgagggcatcattatggtaaagatgcttgtttattattgtttgataaagcaaaagaaaaaggatttaaacaattaatgattacatgttctcctgataatatagcaagtcgtaagattattgagtcattgccatttaagtatcttgaaacaaaagaagtacctgcatgtttgaagaaagattttgatcaaggtgattatataaaaagaatatattgtttggatttggaggagttatgaaatttatacatttagcggatttacatttaggtaaaattatttatcaaaataatctattagatattcaaattgatttattaaatcaagtgatgaattatatggttcaaaaaaaaatagatactttagtaattgctggagatgtttatgatcgtgcgattgcttctaaagaaagtatagttgctttaaatcattttttagaagcaatgattttacattatcataaaaaagtattgatcatttcaggaaatcatgatagcagtgaaagacttgattttgcaagttctttacttcaaagtcaaggtttgtatattgtttcttatcctgaaaaagaaataagaccaattgaaatagaaggtgtttatttttatttggttcctttttttaaaccttcttatatacgttatttatatgaaaaagatgatttaaaaacgtatcaggatgcttttgcatattatttaagtcaacaaacatttgttgaagaccatcctaaagttcttgtaacacatcaatttattgcgggaaataaagaagtgattagaagtgaaagtgaagtaattctttccgtgggtggtagtgaaattattgatgttgatttatgtaaagattttgattatgtagctttaggtcatattcatgcaagtcaaaaaattaaatatgattatgtaagatatgcaggaagtttaatgaagtattcatttgatgaagttcatcaaaaaaaaggaatggttgaagtaactattgatgaaactggggtttctacgcaaattattcctttaaagccacaaaaagatctagtgaaggtcgttggaaaatatgaagatgttttacattatccaaataacgaaaatgattttgtagcggtagaattattagataaacaagtcattggtcatgcatatgattttttaaaagaaaaatacccttatttattacaaattacttatcaatcactagaaaaacttaaaacaaatcaaacagcttcttccttagatgttgaaaaacaatctccaatagaaatatttaaagaattctatgaaaaaatgaaaggtgaagcaatgagtcaagaaagtgaagaaattattcaacaattactagaggaggtaagtgaagatgatgcccattagccttacattatcagcgtttggaccttatccagatacaatcacaatcgattttgaatcatttcaagaagatggtctctttttaattacagggcctacaggtagtggaaaaacgatgatttttgatgccatgatctttgccttatatggtaaaacaagtggtcaaattagacaaacggacagtttaaggtgtgatcatgccttaaatgaaattcctacttttgttgaattttcattttctttgcatcaacaaaattatacaattaaaagaaatcctaaatattatctagaagggaaaaaaacacctaaacaaccttcagcgttacttattttaccagatggcaaaatggtcgaaggtattaaagaagtcaatcaaaaaatgatttctttattaggggtcgatgatcaacaatttaaacagatttgtatgattgctcaaggagaatttacaaaattgattatggcttcaagtgatgaaagagaaaaagtattaagagagttatttcatagtgagacgtatcaaaagttagaagaaaaacttaaagttcatctaaaaacgtatcaggataaatatgatttattattgaataaaaggaaagatttgatgcaagaattacaagttgaagatcatcaagaatatttatctaaacaaacaaaacttatcgcaagtcaacaaaaagaatatgatgatttaaaaaaagatttagatcaaaagaaacaacaattacaactctatcgcttacaaaatcaacgattaatacaattaaaagatttaaaacaacaatttcaagatttaaagaaacaagaaaatgattatcaagaattaaataaaactgtagatactttaaaaaaagcacaagaaacaaattatttatatatttcttatattaaacaacaaaagaaacttcaaaccttaaaattaaatcaagaagattttttaaaacaattaaaaaaacttgaaaaagattatcaagaaaaaaaggtacaagcaaatacgcttactgttaaacaacaaacaaaagaaaaattacaaaaccaaattcaagaaacgaaacaattaatcaatcaaatctatcaatatcaaaatgattatcaaaacttacaaactctaaaacaacaatatagaatgttagatgaagaacataaactctttttaaaaaagaaagaaaaatttgaaaatgggttgcaaagagatcaagaaagaatccaaagtgaacaacaagtacaatctaaatatgaactaatcaaacaacaatatgttcgtttaaacgaacaaaaagtaaaagttcatcaattgtcggattattatgatcaaatactcaaacttaatgaaaataaaagtgatttacaagaagagtatacagttgttgaaaaacaagttgatcatgaaaaaatgcaatataatcaaatggaaaaattgtattttagaaaacaagcgggcatttttgcattacaattaaaagaggatcaaccatgccctatttgtggctctttacatcatcctcatccggcacaaattgaaaaagaagatataacaaaagaaaaattagatcaacaagctaaaaaagtaaaacaacaagaacataggttacaagatatcttacaaaaaatactcttgtctaatcaaaaaaaggaaatgcttgttaaacaaacaaaacaactttcaagtgaacttaatattcaagaagagatatctaaagaaatctttattaaagaattagatcatttatcaaaagatgaaaaaagaatgaaaaaagaatatcttgaattacaagatgaacttaaatatattcaaaagcttaaaaagagtgtggctctttcattgaaagatatgtctacttatgaaagtaaagaattaaaacaagcacaaagtctagagaatattcaagtacaaattcatcaattatctggtaaattagatgattcactgcgacaatatgaaattggagaagttaataaaaattatcaacaagttcaaaaagaatatcgtcaactttcattagaaataaaaactattcaacaggattatgaaaaggtcaaaaataaatatcttgaaataaaaacaaaaatttcgtcattgaatcaacaaattattcaagaacaagaaatatatgatgaattagataataaatatcatactgctttagatgcatttataaatgaagaagaatttttaaatttaaaaacacaaatcaatcaaatcagtatcttggaaaagaaatatcaagattatttaatttctttaaagagtttaaatgaacagattatttcattagaaaatgaagtcaaagattcaacatatgttgatttatcttctttaagtgaaacaattaaagaagtaaatcaacaattgagagaaaaaaatgatgatttagaaaaattaaaaatagattattcattaaaagaaaaaatgatcaaagatattcaaaaaatcaatcaacaattagaaaaagatgaagatacttatcaaagatatttagatctttataatctagcaagtggtaaaaataatgcaagagtgtcgattgaaagatatgtactagcaacttattttgaaaatatgttgatttatgccaatgtgatcatgaaacaattgagtcaaggaagatatcaattattaaggaaagatgatgcaggtaaaggaagaagtcagcaagggttagaattagatgtttttgatcaagaaagtggaaatattagaagtattaagacactttctggtggggaatcctttaaagcggctttatctcttgctttaggactttcaagaatggttcaagattatgctggaggaattgaattaaatacgctttttattgatgaagggtttggttctctagatagtcaatcattagatcaagcaatgaattgtttaatggaattgcatcatgaaaataaattaattggaatcatctcacatgttagtgatttaaaagatcgtattgaacgacaacttgtagttgaaagaaaacaaaaacaaagtgtgatttggatgatctaatcttgcttgtttatcatttctatagtaaaatagaggagcattttagaggaggaaaaaagatggcaaataacaagaaaaatgaagctattactgctagagatgttgattttgctaaatggtatacagatgtatgtcgtaaagctgaattaatggattatagtggtgtgaaagggtttattatttatcgcccttatggatatgctttatgggaacaaattcaaaatcatatggataaaaaatttaaagaaacaggacatgaaaatgtttatatgccgatgttgatccctcaatctttattacaaaaagaagctgatcacgtagaaggttttgcaccagaatgtgccgttgttacaaaaggtggtttaaatgaattagaagaaaatttgattattagacctacttctgaaacattgttctgtgaacattatgcaaaaattgttaattcttatcgtgatttaccaaaattatataatcaatggtgttcagtagtacgttgggaaaaaacaacaagaccatttttacgtggatctgaatttttatggcaagaagggcatacaattcatgccagtgaagaagaagcaagaaaagaaactttacaaatgttagaaatttatcgctctactgcacaagatttacttgcaattccaatggttactggacgtaaaactgaaagtgaaaaatttgcaggggctgaagaaacttatacaattgaagctttaatgcatgatggaaaagctttacaatcaggaacatctcattattttggtcaaggttttgcaaaagctttcgatgttaaattcttaaataaagataataaacaagaatatgtttatcaaacttcttggggagtatcaacacgtttacttggagcaattattatggtacatggtgatgataatggtttagtcttaccaccaagagtagcgccaattcaagtaatgatcgttccagttatgcaacataaagaaggcgttttagataaggcttatgaaattgaaaaacaattaaaagcagctggacttcgtgttaaagtggatgcgagtgataaaacaccaggttataaatttgcagatgctgaaatgagaggaattccattaagacttgaaattggacctaaagatattgaaaaaggacaatgtgtcttagctaaaagattagatggtacaaaagaaacatatgctttaaatgaagaattaccaaatacaattcatcaattattagaccaaattcatgatgaaatgtatgcaaaagcattgaaatttagagatgaaaacattagaactgcgaaaacatatgatgaatttaaagaaatcttaaatactaaagcaggatacattcgtatgatgtggtgtggagatgaagcttgcgaatctcaaattaaagaagaaacaggggctacatctagatgtatcaaagaagacgaagaagcatttggtgatgtttgtccaatttgtggtaaaccagctaaaaaagttgtttactttgcaaaagcatattaaggcattcaattgaatgtcttttttaattgacgattttttcacatcaaagatataataaacaaaaggaagtcattatcttaatgtcaaacattaaaatataagtaatgtctaaagacaacaatgaagaataaaaaatacaatacgtcatcacactttactgaaatggttggaataattttatttatcattttttcatttttgtttatacatttatattacaaaaaaattatagttcgaatactttagaagctgctgttgatcgagatattgaatgttcagatgctattatgaaattgatttctaataagattactcaggaagattttttagatattagttcaaaaaaggatatgtccaaacaacgttatcaaacattacaaaaaagtcttaatgaattaagaacattaaattcaacacgttatttatatactgctaaaaaagatcaacaaggacatttagtttatgttattgatgtttagatttaaatgcagatgattttgcttatccaggaacacgtattgaaaaagaaatgattccctatattaatcaggctttaaaaggaaaaaaggtatattctcaagaaattgtagatacaacatggggacatatttttacagcttgttatcctatttatgatcaagaagaaatagtaggtgctttatgtattgagatggatatggaatcttcttataagtttttagaagcaagtaatcgggattcttataaagtagcctttattgctatttttgttgctttaatgctttttatttgtatttatatttcttttagaaaacaaaaattagctgatcaagctcaacaacaattactagaagaaactgctaaagttgtcaatgctgcaagccaagctaaatcttcatttctatttaacatgtcacatgatattcgtataccaatgaatgctattattggctatagtcaattagcaaaaaaagaaatgaataacatttctaaagtaagtcagtatcttgataatattcttttatgtggacaaaagatgttatcgattatcgataatattttagaaataacacgtattgaaaatgataaggtacaaatagaatatacaattaaagatattgagcaaatatttgatgtttgtttaatgatggaaaaaccggctattgaagaaaatgctttagatattcaagttaataaagaaatcatttatctttatgtttatgttgatgaagtacatttattagaaattattttaaatctgtttagaaattctattaaatataccaatcaaggtggaaagattatttattcattaaaacaagaaatgctggaaaatgaatgtatcaatataattactatttgtgataatggatgaggaatgtcagaagagtttcaaaaacatatttttgattctttttctcgagaacgttcttcttcagacagtggtatagagggtacaggacttggaatggggattgctaaaaagctaattgatttaatgaatggaacaattaaagttgaaagtcaattaggtaaagggacgagatttactgttaaaataccaagtaaaatatctcaaaaagaagatattttatatcaaccttctttagagccgattgaaaatagaaatcttaataataaaaaaattttattatttgaagataatgattttaatgtagaaattattattgaattattaaaagaaaaaggattatatcttgaaagagtggctaatggtatagaatgtttagatattttaaaagaaaaagattatgatctaatattaatggatattcaaatgcctttaatgaatggttacgatacgaccattgcaattagaaaattaactgatcaacaaaaagcacaaatacctattattgcacttacagctaatgcttttgcggaagatcgtcaaaaagcattggcagtaggtatgaatgattttattgctaaaccgatagatctgcaaattttattaccattattagcaaaatacttataaatcgattatttgatcggtttatttttattgacaaaaaatagaaaatgaattattgttgatatgtcaactataggaggaactatgaatttaacacgtttaatttctattcttcataatcaaaaaaacagttatatgaatgttcaacttaaagatataggactatctcatggacaagcaattgctttaaagattatttatgaagaagctacaatcaaacaagaggatttaaataaaagattacagattgataaaagtgcggttacaagaatattaaatactttaaaagaaaagggtttgattattaaagaaatagccaaggaggataaaagaaatcaaatgatttctttaactgaaaagggaaaagttctttatcctcaaataaagaatattattgaaaaaacaaatgaagtaatgttaaaaggtattaatcaaaatcaacaaacattattaaatgaattaattttaaaaatgaaagataatttggaggaaaaaaatgaaaaatgatgataaaatgggaactaaaaaggttttacctttattagtagaattttcaattccagcaattataggaatgttagttaatgcaatttataatatcgtcgatcgtatgtttatcggaaatgcaccagaacttggatctgttggattagcaggtattagtatttgttatccagtaacccttgttttaatggctatttctttaatgattgggatgggtggtgcgactcgtttttctattgctttaggacaaggtaaaaaagaagaagcaggtaaatatatgggaaatgggttgactttaacgattattttaggttttttatttatgattttaggaaatctttttttagcaccaatgttaaaggtgttaggtgcttctaaaactgttttaccatatgctgaaagttatttaagtattattttatatggggctgtttttcaatgtgtagcgatggctggtaataacttttctagagcacaaggtaatcctaaaaatgcaatgatttctcaattaataggagcaggttttaatattctatttgattatattcttatttgtcttttacatatgggaatggaaggagctgcacttgcaacaattggtggtcaattattaagtgctttatggcaacttgctttcttatttggtaaacgtacgattatttctttaaatatttcattacttaaattaaaattaagtgtttctaaacagattattcaaacaggaataccagcttttttaatgcaaatatcgaatagtgttttaaatattattttgaatgcgtctcttgttaaatatggtggagatttagcgttaagtgctattggtattgttacaagcattcaaacacttattttaatgccaattactggtttgatgcaaggtcaacaaccattgatttcatataattatggtgctttaaaaatggatcgtgttaaagaaacattaaaatacgcaattataggtgctacaatgattgctttgattggttttatcgcagtacaattttttacaaaaagtattgtctatatgtttaatgatgaagcagatgttgtaaaattatgtagccatgctttacatatttggtttatgtgtttaccggttattggtgcacaagtaatgtgtgcaaactattttcaagcgattggtaagataaaaatatcaagtgttttaaatttattgagacaaattattattttaattccttgtatcataattttttcatcgattataggtttagatggtatttttatagctgtccctgttgcggatctatcagcgtttattattactgttttattattaaaaaatgccttaaaaaaagaagcctgagcttctttttaattatatctttttacaacgaattgattcaataacaggttgattttctttttttacagttccattattatcttctacttttacatctttacaaatttgatcaacaatgtccatgccttcataaacataaccaaaaacagcatattgaccatccaaataagtagaatcactttgaacaataaagaattgtgaagaagcactatcattatcttgacttcttgccatagaaagagctccacgtgtatgacttaaaggattttttaccccattatctgaaaattctcccttaattgtttctttacttccaccagtgccatctcctttaggatctccaccttgaatcatgaaaccatcaataatacgatgaaaagttaaatcatcataaaacttttctttacttaactttacaaagtttgttactgtaattggtgctgtatcagcatcaatttcagcataaattgttccataatccttaactttaatttcaacttgataatttcctgataaagtttttgtttttttagttgctttttctgttgttgttttagaagaacatccagcaatggaaacaacagtcattaaaactaaaactacttttagcatttttttcattcatttcacctctttcaatattataacaaatatgaattatgaaaaaaagatactcaataagacttgattgtgctaaaatacatgaaagaggttttaaagatgagagaaaaaagaattgtattagtaaatgatgtaacaggattatcaagatgttcagtagcctgtcaattgccaattatttcagctatgggaattgaaacagcttttgtaccaacagcaattttatctatcaatacataccataaagatttcttttttgatgattatacatcaaagatgaatgattatattgaaacatataaaaaaatgaatattgattttgatggaatatgcagtggctttttaggatctgcgaaacaaatagaaatagtaaaagaattttttaaagattttaaaacagaaaaaaactttattttagtagatccagtcatgggtgatcatggaaaactttatccgacttatacgcgagaaatgcaagaaaaaatgagagaactcatgccttatgcggcaattgttacacctaatttaacagaattgtgtgctttgattgatgaagcttatcatgaaacaagcaatgagcaagaacttaagcgcatgtgtgaaaaattaagtcaaatgggtccaaaaatgattgtagtaacgggtatttctattggtcatcaaattttaaattttgtttataaccatggaaaagttgaaaaaatctatgcgaaacgtattggagaagatcgtagtggcacaggagatgttatttctgcagtaattgcaggaagctatttgaaagagaaaaattttttagaagctgttaaaaaatcaacagattttgcttctaaatgcattcaacattctgtagatattgatgctcatccacatatgggattatgttttgaaccattattaaaagaattgggggattaagatgatattatatacattatataaaaatagttatattgatattgcacatttagaaagtactaaagggattacatgttatgttaattcgacaaatcgttgtacatgttcatgtacattttgtttaagacaaacaaaggaaatgattgaaaataattctttatggttaaaagaagaaccaacggttgatgaaattattcaagaatttgaaaaatatgatttaaatgattttaaagaagttgttttttgtggttttggtgaaccacttataagacatgatgatttaatgaaagttgctaaatatttaaaagaaagaagacctgatctacctacaagagtgaataccaatgggttatcttctttatataataaaagagatattacgcctgaatttaaaggattgttagatactgtttctattagtttaaatacaagtaataaagaagattatttagaacttacaagaagccaatatggaattgattcatttgatgaattattagattttgctaaaaaatgtaaagcctatgtgcctcatgttgttttaacgattgttgatacaacaattcctgaaaaagatgtagaaatttgtaaacagattgctcaaaatattggggtaactttaagaataagaccatttgaagattagtgaggaaagaaaaaatgatgcaattatctcgtgaagaaagattacttcatataggaaaaatgaccaatgtaagagatttaggtggttatgaaacacaagaaggatattatacaaaatcacataaatatgttagaagtacatgtccaagttggatcagtgatgatttaaaagaacaattttatcaatatggtattcgcactgtcattgatttaagaagtgattatgaattagttcatcaaccacatagtttaaaagggtataaagatatagagtattatcatattaatttactacaaaatgaaaatatgtcagtattaccaaatgatattaaagactatcaagatttaagtggtttttatatttttatgatcgaagcgaataaaaaacaatttaaaaaagtatttaatatctttttaaatcatccttatgactgtacattatttaattgttctgcaggtaaagatcgtacaggtgttattgcatgtatgttattagatctagcgggatgtcatgaatatgatattgttaaagattattcagaatcttatgaaaataatatggcaatgatcaaacaattggaagaaatgatgccaagtgaagatgaaaaattcttaggttctgatccaagagtgatgatgaaatttattgcgtatttaagagaaaattatggtagtactaaaggatatttattaaatattggttttagtgatgaagaaattgaagaaattaaagaaaatttcataatttaaaagaaaaaaggcctcctattgtcatatataaacataggaggtttttttatgaaggcattaacgtttaaagaaaaacaagatgttttagaagatctatttaaaaagtatcaccgtgctgttttacaacttaaatgtttagaagaaaggaatttttatccatcgattcaatttgataccgttaaagaaaagaagatgtattatcaagataaaggaagtcaattgaatgatcaattggtgttaaaagaagaattagagaaagttattgcaacatttgaatttattttagattgtttatcgatggagagtaaaattattattgaaaaagaatttatagagagagttggtaaagattggtggattgattattattctcggagtacatactatcgtcttaaaacaagggccatggaagaaactttgttctattttagttgtttataaaaatcataaagtttaaatataaagcaaagaataaccaaagaatataaggaatatttagataataactttttggattaatttttttaaaaatgatcaacatataaataacagtaagaatcaaagctattaaaatcattaatgaaagaaaataattatgaagattaaaaaagaaaagtggccaacaaaaattaataaataattgaaaagagtagacaattaaggcgttttcacgtttaggatcatgactgatataaataaaataactagaaattcccatcaaaatataaagaagggtccagacaataggaaataaccatcctggaggagccaataagggggtatttaaattgctatatgtttccatttgattatttgtgataaaagcgcttatagcacctactaataaaggaataatcaaactaataatgaatgttctttttttcataatgttcacctagtttagtatatccctatttatttaaaaatatacgttcaaatcatgaatgagatgttatataatagaatatattggagaaagaggtaattatgaaattagtaagttggaatgtaaatggaataagagcatgtttacaaaaaggttttttagatagcttttatcaattagatgcagatattttttgtgttcaagaaactaaaatgcaaagaggtcaagcagatttagagattgaagggtatcattattatttaaacagtgctgttaaaaaagggtatagtggaacacttatttatagtaaagaaaaaccattgaatgttttttatggaatgaataaagaagaacatgatcaagaaggtagattaattactttggaatttgaaaattattatgtcattacttgttacactcctaatagtcaaaatgaactcaaacgtctatcttatcgtatgaaatgggaagatgattttttaacgtatcttgaaagtttagataaaccaattattttatgtggtgatttaaatgttgctcatcaagaaatagatttgaaaaatcctaaatcaaatcgtaaaaatgcaggtttttctgatgaagaaagagaaaaaatgactcagttattaaatcacggttttatcgatacgtatcgttatctttatcctttacaagaaggtgtttattcttggtggtcttatcgttttaaagcaagagaaaaaaatgcgggatggcgtattgattattttattgttagtgatagcttaaaggataagattattgatgcaacaattgaaacagagattatgggaagtgatcattgtcctgtaactcttacaatagatctttagcggaggtgtattatgaatataatacaaatgattaacgtttcaccactagtcacaatttctattattgccttgactattgatctaacgatttttggttattattatattaaagcaaagcattaaaaaactgctacgtttatttgtagcagttctttttatttttctaaatgtttacaactgtaataagaaggaataccatctttataagtaacatgtacttcaccttgaataagtggatataaatattcatatagttcttgagtaatatcatttccttcttgattgatccattttacaggaattttttgttcataattagcaacttctcttacatcagtagaaatataatcgatttcataaggatgattagaaagacgcttaaatcccattacatgaccagaaacgttttctaaagctttatcgatagctttagaaccaataacaaatgattcatttaaatctgttttactagcaatgtgcatagcacatctttgtaaaacgtttaattcaatacttctaactttacatccaaattctttaaatacaagagattcaagtaattttcctgttcctgaatgtaagacatgtccaaaagcatcttttttagcgtatttactatcatcatctaagaagtgaccgttttgatctctgataccttcagatacagcaatgacaacacatctttttcttttcatgacttcatgaatatctgctaaaaacttatctttatcaaaaacaacttctggtaaataaataagatcaggagctacattatattcatttctcgcaagagcagcagcggcagttaaccaccctgcatttcttcccatgatttcaatgattgtaacggattgtaattgataaattaaactatcatgtacaacttctaagatagaagcagcaacatacttagcggcagaaccaaatcctggtgtatgatctgttcccattaagtcattatcaatggttttaggaataccaataaaatgaatatcactattaatatatttagcgtaatcatctaatttcataacggtatccattgagtcattaccaccaatatagaaaaaatcagtgatttctaattcttttaaaattctaaacaatttaacataagtatcttcgtcatcttgaaaagtaggtaatttataacggcaagaacctaaatacatggcaggtgtttgttttaaagcattgattttatcaccatcatcaaattcttctaataaatccatatatctaccttcgagtagacctttgataccattgatcatcccataaacattttcaaattcttgagatgctttagcacgatgaataatcccagcaagactagcattaattgcgattgtgggtcctccagattgtccaataatacagtttcttttcatattcttcttgtctcctttaacgcctttattctatcaaatacccgcattaaagaaaagtaatcttctagtctttttgtctttttttgatgaaaataaggataatgattaaaacaagtaaaatgatgagagttataaaataaagtaataaatgattattttctttttttgaaatgatacgaaaagataaagctttttcttcaataaaaagttcaaagagattaattgttactacattttgttgatatttgccaacattgctggaaataattgtacctggcatagtaattttaaaagagcaggtagcattactagaatttaaaagttgtaaagtatttttataatgattcaattctgaagtatcgagcatatttttaggaatatcaatagataaaatatatttattattttgttttgtaagcgtagaaatttctttaataaaagaagtaggagattctatcgaaagtgaagaatcggtttgtttttttattgtccaatctttaaaaaaatcataatccaataattgtttttttatttgtgaaatagacatgctatatttttctaaaatttgaggctctattgtaagttcaccataaagagtaggtttttttattttagaataatttaaagaaactaaacagtctacacagccagtaagtaaaaaagtaaaagataaagttatacaaatttttagtatttttttcatagaatcctccaaataaacaataggttttgttataattattaacaattaaatacatttttagttcatatttctgtattaaaataaattaggtgatagaaatgaaaatcgatattgtttatacaacaaaatctaaatatataaagtgtgtcgctgatgaaatggcaaggtgggtcaaaacacatgctcaagatttaaatcattatcatagcgatcatgatgttgatttacttgttattgggtttgatgatacgttatttgaagataaacagttgctggaatttatacaatcattaagtcggcaaaatgtaaaaaatctagcattgatcaattgtttttttattaatagcaaaagattgatgaaagtaattcatctttgtcaaaatcaacaattacctcttatgagagaacaatatacttttaaaatgtcctttgatcaaagaaaggaaatcgatcctcttattattgataatgcaagactttatatagaagatatggtaaatgttatacgaaattactattaggagcgaggctccttttttttattttcttattgtaataaaaaaatattaaatcaataaaattatattgacactaatttatcaacgtgatatatttttgtcaagatttctaaaagggaatggaaatcaataaaaaagggggaaaacttatgaaaaaacttgaaatcattatcagaccagaaaagttagaagatttaaaagatattttaacagtttctggtgtaacaggtatgatgatttccaatattatggggtttggaaatcaaatgggttatacacatcaatatcgaggtgtcacatattctgttaatcttgtttcaaaattaagagttgaaacagttgttaaagatgaaatcgttcaagaaattgttgataaagttactgaaactttatcaagtggaaatgtaggagatggaaaaatctttatttatccagttgaagaagcgattcgtattcgtactggagaaaaaggggaaaacgcattataaaaattgagggggatttattatgagtgaaacatttagcgtatggtttctaattggcgcagcgctggtattttggatgcaagctggattcgccatggtagaagcaggatttacaagatcaaaaaatacagggaacattattatgaaaaacttaatggatttctgtattgggacatgtacatttattttaattggttttagtttattattaggagaagatttacttggttttattggtaaaccaggatttgatatatttacaagttatgcaaactttgatttttcaaactttgtttttaacttagtgttctgtgcaacaactgctactattgtttcaggagcaatggcagaaagaacaaaattcttatcttattgtgtttattcaggagttatttcagcacttatttatccaattgaagctcattggatttggggtggtggatggttatcacaacttggattccatgattttgctggatcatgtgcaattcatatggttggtggtatctctgcattaattggtgctaaaatcttaggacctcgtattggtaaatttgatacagataaaaatggaaaagttgttaaagttaacgcgattccaggacataacattactgctggagctttaggtgtctttattctttggcttggatggtatggattcaatggggcagcggctacaactgttccacaacttggttcaattttcgtaacaacaacagtggcaccagccattgcaactgtttcttgtttgatctttacttggatcaaatatggtaaacctgatgttggtatgtgtttaaatgcttcacttgcaggtttagtagcaatcactgctggatgcgacgtcacagatgttttaggatcgattattattggtgctgttgctggattacttgtttgccttggagtttggttcttagattataaattacacattgatgatcctgtaggtgctgttgctgtacattgttgcaatggtatttggggaacaattgctgttggtttatttgcgacaacttctgcaccagaaagtactttaacaggtttattctacggtggtggatttgatttattaattaaacaattaacaggtgttttatcagtaggtatttggacagcgattactattacaattactttctttatcatcaaaaaaatctttggattacgtgtatctgaaagagaagaaatcatgggtcttgatttagaagaacatggatgtgaagcttatccagaatatattaaaaaataatttttgaagggtcattaaattgactcttttttattgtagaaataagcaaagtagattatacttttcatgggtgaggggagtatatgagtaaaagattagaacaatatttttatttagttttaggttcaacattgttgacactaggtatttggttgtttgtgacaccaaatcaaatcaactttgggggaatgattggtttagctcaattaattgattattttatacataagtttttagttttaccaaaatcattgaatacattaggaatgatcaacttattaatgaatattccattatttatttttggatataaaataatgaataaagaattttgttttaaaacaattatttctttaattatccaaactgtattactatccattcttccagcaatcaaagaaccgattgttgaagatgctttattaaatgttgcctttgcggccattatttgtggaataggagtagggcttgcacttcgaagtagtggatgctgtgggggtattgatattgtgacagtttgtttagttaaaaaaaatccagattttaaagcagggcagctttctataatatttaatgttgttttgtttggaatatgtttatttatttatgatattaaaattattatgtattcaattgtctttgtcgcaattctttatacaacagcagataagttccatctacaaaatatcaatgtagcggtcttaatatttacaaagaataaagaaattaaagaagcgattatgaaacaaatgggtagaggagttacctattggatgggcaaaggcgcttatacagaaacagatcaagaaattctttatgtggcaatcaataaatatgaaattcaacaacttaataaaattgtttcttcattagatcccaaagcctttgttacattagcacaaggtccaatggttcatggagggtttgaaaaaagattataaaaaaaggcatcaaaattgaagtgaactgaataagttggaccaacaacttaggaggttcacttttattatgcggtatacaaaagaatttaaattagaatgtgttagaaaatatatgaacggagaacatatacctgatcctggtggatgtactcatagaacattttatagaaatgttttaagatgggttaaaatttttaatcagcttggagaaattggattagaacataaaaaaccccctatttcatcagaacaaaaattagctttaattaacagggttatacagggagaatcatattgttcagttgcatattctataggtaggcaagaatcctatgtgtccagaatatataagctttatttacaagaaggaattgatggcttacaatcacattgtaagaaaggtaggccatccaaaatgaaaaaagaagaacagaatatagatttagaatcattatctcaagaggaacaaatcaaaatactgaagaaacagctcgaagaaaaagaagtagaggtaaaatatctaaaaaaattagccgccttggttcaaaagaggaaggcccaacaacaaaagaaaaagtaagtgttgttgatgaactaaggttagaatataaactatgtgtcatcctcaaagcagcacatatagccaaatcaacctatgaatactataaagaatcaaaacatttaaaagcggaagaaaagagaaagtctaaagataatgaaatattatcagtagtaaaaccaatctatgaagaaaataagtcccgttatggatatagaagggtaatattatcaatagattcaaaaatattgtcaaaattaaatgtaggaagagatcgtataagaaaagtattaagagataatggattactaggaattcaaggaagaaaccataaatatcattcatatacaggtgacaatggcatggataaaagaaatcttttgcttgctaaagaagtagatgaaaaaaatcataaaacgacatataaacgtcattttgaaacaacaggtccaaatgaaaaatggacaacagatgtatcggaatttaaattacctacagggaaactttacttgtcaccaattctagatatgtatgacagttcaattatttcttatgatatttctacttcaccaagtttagaacaaacaaaaagaatgttaaatgaggcatttaaacaatatccaaatttagaaggattaatatttcatagcgatcagggatggcaatatcaacatcaatattatataaatgaattaaagaaggcgattgaagaatatattaaatattacaatgagaaaagaatcaatgtaaaaagaaaaggattgagtccattagcttatagacaacaatccctatcttaaattttatagtccaactatttcagtgcactacaaatgatgcttttttgtatacgtaaaatcaaataaaaaaatggtggttccgggcggaatcgaaccaccgacacgaggattttcagtcctttatcagtaactcgttggggacctgactatggtgatcctacaacttacttaacattagctttaactgacaacaataacaactatggtcattggtcaaatgctgagtatgattcaatcatgggaaaagttagcagtgaaactgatgctaatgctcgttggcaattaatgatcgatgcagaaaaaattatgatggatgatttatgttacatcccagtattcgaaaaaggaactgctactttacaaaatacaaaagttaaaaacttaggtattaaaccagttggtgttccatatacattcgaatatgtatcaaaatagttcaatctaaaaaagaacatagagaagacaacacaatatagtattctgtattgtgtttcttttttaaataaataaaggaggaaaaaagatgagtaattcaaccttaaaatatatcggaaaacgtttagttatttcgttaattactttattcgttattttaatggtattatttttaatggttaaatttttaccaggttctccaattaacaatgaaaaattaagtgcttcagccagagctgctattgaagcacaatatggattggatcaaccaattccggttcaattcgtacgttatattcaaaatatgttaacaggggatttcggggtatcatttaacttatacaaagatatgcaagtatcttctttagtaggaagtgctgcaaaattatctatgatttatggtttatgtgcagttattattggaacaattattggtatgttcttaggagtatttgctgcattacataaaaatacaatttgggatacaattgctacagtaatctcagtaattggggtttcaatcccatcattcgtatttgcaatgttaattttattattatttgcttcaaaattaagattgttaccaacttcatatagttcatcgaatgcaattaaatcatcaattatgccaattttagctttatctgttggtgttattgcaaacgttgcacgttttactcgtactgaaatggtatcagttttaacaagtgaatatatgactcttgcaaaagcaaaaggattagatcgtaaaactttaattttcaaacatgcattacgtaatgctttaatcccagtaattacaattttaggacctatcttagttaacttaatgacaggtactatggttgttgaaaagatttgttctgttcctggattaggtaaattattaattaatagtattttatcaaatgattacaacatcattttagcttgttcattcttatatgctgcaatgtacatttt
